(12) United States Patent
Baker et al.

(10) Patent No.: US 7,335,732 B2
(45) Date of Patent: Feb. 26, 2008

(54) PRO9799 POLYPEPTIDES

(75) Inventors: Kevin P. Baker, Darnestown, MD (US); Audrey Goddard, San Francisco, CA (US); Paul J. Godowski, Hillsborough, CA (US); Austin L. Gurney, Belmont, CA (US); Victoria Smith, Burlingame, CA (US); William I. Wood, Hillsborough, CA (US)

(73) Assignee: Genentech, Inc., South San Francisco, CA (US)

( * ) Notice: Subject to any disclaimer, the term of this patent is extended or adjusted under 35 U.S.C. 154(b) by 533 days.

(21) Appl. No.: 10/216,160

(22) Filed: Aug. 9, 2002

(65) Prior Publication Data
US 2003/0100708 A1    May 29, 2003

Related U.S. Application Data

(63) Continuation of application No. 10/119,480, filed as application No. PCT/US01/21066 on Jun. 29, 2001, now abandoned, which is a continuation-in-part of application No. PCT/US01/17800, filed on Jun. 1, 2001.

(60) Provisional application No. 60/222,425, filed on Aug. 1, 2000.

(51) Int. Cl.
*A61K 38/00* (2006.01)
*A61K 38/17* (2006.01)
*C07K 14/00* (2006.01)

(52) U.S. Cl. ............... 530/350; 514/12; 530/387.3

(58) Field of Classification Search ............. 424/198.1; 514/2, 12; 530/300, 350, 399
See application file for complete search history.

(56) References Cited

U.S. PATENT DOCUMENTS 5,536,637 A     7/1996  Jacobs
6,639,063 B1 * 10/2003 Edwards et al. ........... 536/23.5

FOREIGN PATENT DOCUMENTS

| WO | WO 00/26243 | 5/2000 |
| WO | WO 01/12662 | 2/2001 |
| WO | WO 01/55314 | 8/2001 |

OTHER PUBLICATIONS

Skolnick et al. (2000). From genes to protein structure and function: novel applications of computational approaches in the genomic era. Trends in Biotech. 18(1):34-39.*
Bork, A. (2000). Powers and pitfalls in sequence analysis: the 70% hurdle. Genome Res. 10:398-400.*
Doerks et al. (1998). Protein annotation: detective work for function prediction. Trends in Genetics. 14(6):248-250.*
Smith et al. (1997). The challenges of genome sequence annotation or The devil is in the details. Nature Biotech. 15:1222-1223.*
Brenner, S.E. (1999). Errors in genome function. Trends in Genetics. 15(4):132-133.*
Bork et al. (1996). Go hunting in sequence databases but watch out for the traps. Trends in Genetics. 12(10):425-427.*
Wells, J.A. (1990). Additivity of mutational effects in proteins. Biochemistry. 29(37):8509-8517.*
Ngo et al. (1994). Computational complexity, protein structure prediction, and the Levinthal paradox. In Merz and Le Grand (Eds.) The Protein Folding Problem and Tertiary Structure Prediction. Birkhauser:Boston, pp. 492-495.*
Pennica et al. (1998). WISP genes are members of the connective tissue growth factor family that are up-regulated in wnt-1-transformed cells and aberrantly expressed in human colon tumors. Proc. Natl. Acad. Sci. USA. 95(25):14717-14722.*
Haynes et al. (1998). Proteome analysis: biological assay or data archive. Electrophoresis 19:1862-1871.*
Sen et al. (2000). Aneuploidy and cancer. Curr. Opin. Oncol. 12(1):82-88.*
Saito-Hisaminato (2002). Genome-wide profiling of gene expression in 29 normal human tissues with a cDNA microarray. DNA Research. 9:35-45.*
Hu et al. (2003). Analysis of genomic and proteomic data using advanced literature mining. Journal of Proteome Research. 2:405-412.*
Chen et al. (2002). Discordant protein and mRNA expression in lung adenocarcinomas. Molecular and Cellular Proteomics. 1:304-313.*
LaBaer, J. (2003). Mining the literature and large datasets. Nature Biotechnology. 21(9):976-977.*
Lichtinghagen et al. (2002). Different mRNA and protein expression of matrix metalloproteinases 2 and 9 and tissue inhibitor of metalloproteanases 1 in benign and malignant prostate tissue. European Urology. 42:398-406.*
Lian et al. (2001). Genomic and proteomic analysis of the myeloid differentiation program. Blood. 98:513-524.*
Fessler et al. (2002). A genomic and proteomic analysis of activation of the human neutrophil by lipopolysaccharide and its mediation by p. 38 mitogen-activated protein kinase. The Journal of Biological Chemistry. 277(35):31291-31302.*
Feroze-Merzoug et al. (2001). Molecular profiling in prostate cancer. Cancer and Metastasis Reviews. 20:165-171.*
Gygi et al. (1999). Correlation between protein and mRNA abundance in yeast. Molecular and Cellular Biology. 19(3):1720-1730.*

(Continued)

*Primary Examiner*—Christine J. Saoud
*Assistant Examiner*—Jon M Lockard
(74) *Attorney, Agent, or Firm*—Elizabeth M. Barnes; Mark T. Kresnak; Ginger R. Dreger

(57) ABSTRACT

The present invention is directed to novel polypeptides and to nucleic acid molecules encoding those polypeptides. Also provided herein are vectors and host cells comprising those nucleic acid sequences, chimeric polypeptide molecules comprising the polypeptides of the present invention fused to heterologous polypeptide sequences, antibodies which bind to the polypeptides of the present invention and to methods for producing the polypeptides of the present invention.

6 Claims, 246 Drawing Sheets

OTHER PUBLICATIONS

Bustin et al. (2002). The value of microarray techniques for quantitative gene profiling in molecular diagnostics. TRENDS in Molecular Medicine. 8(6):269-272.*

Hegde et al. (2000). A concise guide to cDNA microarray analysis. Biotechniques 29(3): 548-562.*

Lilley et al. "Proteomics" Molecular Biology in Cellular Pathology, (2003) England: John Wiley & Sons, pp. 351-370.*

Wildsmith et al. "Gene Expression Analysis Using Microarrays" Molecular Biology in Cellular Pathology, (2003) England: John Wiley & Sons, pp. 269-286.*

Hegde et al. (2000). A concise guide to cDNA microarray analysis. BioFeature. 29(3):548-562 (pp. 548, 550, 552-554, 556, 558-560, and 562 ONLY).*

Lee et al. (2000). Importance of replication in microarray gene expression studies: statistical methods and evidence from repetitive cDNA hybridizations. Proc. Natl. Acad. Sci., USA. 97(18):9834-9839.*

King, H.C. (2001). Gene expression profile analysis by DNA microarrays: promise and pitfalls. JAMA. 286(18):2280-2288.*

Waghray et al. (2001). Identification of androgen-regulated genes in the prostate cancer cell line LNCaP by serial analysis of gene expression and proteomic analysis. Proteomics. 1:1327-1338.*

Sagynaliev et al. (2005). Web-based data warehouse on gene expression in human colorectal cancer. Proteomics. 5:3066-3078.*

Nagaraja et al. (2006). Gene expression signatures and biomarkers of noninvasive and invasive breast cancer cells: comprehensive profiles by representational difference analysis, microarrays and proteomics. Oncogene. 25:2328-2338.*

Klein et al. Selection for Genes Encoding Secreted Proteins and Receptors. *Proc. Natl. Acad. Sci.*, 93:7108-7113 (1996).

Ørntoft, T.F., et al., "Genome-Wide Study of Gene Copy Numbers, Transcripts, and Protein Levels in Pairs of Non-Invasive and Invasive Human Transitional Cell Carcinomas", Molecular & Cellular Proteomics; 1.1:37-45 (2002).

J. Quackenbush, "Microarray Data Normalization and Transformation", *Nature Genetics Supplement*, vol. 32, pp. 496-501, Dec. 2002.

Beer et al., Nature Medicine, 8(8):816-824 (2002).

Database EMBL [Online] Feb. 22, 2000, "Homo sapiens cDNA FLJ20127 fis, clone COL06176." XP002372178 retrieved from EBI accession No. EM_HUM: AK000134. Sugano et al.

Database SWISSPROT [Online] Feb. 1, 1996, "Brush border protein AdRab-A precursor." XP002220546 retrieved from EBI database accession No. Q05004. Boll et al.

Boll W et al., "Messenger RNAs expressed in intestine of adult but not baby rabbits: Isolation of cognate cDNAs and characterization of a novel brush border protein with esterase and phospholipase activity" Journal of Biological Chemistry, vol. 268, No. 17, pp. 12901-12911, Jun. 15, 1993.

Abe, N., et al., "An Increased High-Mobility Group A2 Expression Level is Associated with malignant Phenotype in Pancreatic Exocrine Tissue," *Br J Cancer* —89(11):2104-9 (2003) Abstract.

Ando, M., et al., "Selective Apoptosis of Natural Killer-Cell Tumours by I-Asparaginase," *Br J Haematol.*,—130(6):860-8 (2005) Abstract.

Aust, G., et al., "Human Thyroid Carcinoma Cell Lines and Normal Thyrocytes: Expression and Regulation of Matrix Metalloproteinase Inhibitor-1 Messenger-RNA and Protein," *Thyroid* —7(5):713-24 (1997) Abstract.

Barnes, V.L., et al., " Expression of Embryonic Fibronectin Isoform EIIIA Parallels Alpha-Smooth Muscle Actin in Maturing and Diseased Kidney," *J Histochem Cytochem.*—47(6):787-98 (1999) Abstract.

Bea, S., et al., "BMI-1 Gene Amplification and Overexpression in Hematological Malignancies Occur Mainly in Mantle Cell Lymphonas," *Cancer Res.*— 61(6):2409-12 (2001) Abstract.

Blaschka, V., et al., "Rapid Quantitation of Proinflammatory and Chemoattractant Cytokine Expression in Small Tissue Samples and Monocyte-Derived Dendritic Cells: Validation of a New Real-Time RT-PCR Technology," *J Immunol Methods.*—246(1-2):79-90 (2000) Abstract.

Buckley, A.R., et al., "Butyrate-Induced Reversal of Dexamethasone Resistance in Autonomouse Rat Nb2 Lymphoma Cells," *Apoptosis.*—2(6):518-28 (1997) Abstract.

Caberlotto, L. et al.,"Alterations in Neuropeptide Y Levels and Y1 Binding Sites in the Flinders Sensitive Line Rats, A Genetic Animal Model of Depression," *Neurosci Lett.*—265(3):191-4 (1999) Abstract.

Caberlotto, L., et al., "Neurokinin 1 Receptor and Relative Abundance of the Short and Long Isoforms in the Human Brain," *Eur J Neurosci.*—17(9):1736-46 (2003) Abstract.

Choi, D., et al., "Characterization of Cyclin D2 Expression in Human Endometrium," *J Soc Gynecol Investig.*—9(1):41-6 (2002) Abstract.

Couvelard, A., et al., "Human Chorionic Gonadotrophin Beta Expression in Malignant Barrett's Oesophagus," *Virchows Arch.*—445(3):279-84 (2004) Abstract.

Dagenals, A., et al., "Downregulation of EnaC Activity and Expression by TNF-Alpha in Alveolar Epithelial Cells," *Am J. Physio Lung Cell Mol Physiol.*—286(2):L301-11 (2004) Abstract.

De Boer, C.J., et al., "Involement of the CCNDI Gene in Hairy Cell Leukemia," *Ann Oncol.*—7(3):251-6 (1996) Abstract.

Debieve, F., et al., "Inhibin and Activin Production and Subunit Expression in Human Placental Cells Cultured in Vitro," *Mol Hum Reprod.*—6(8):743-9 (2000) Abstract.

Dong, Z., et al., "Expression of Membrane-Type Matrix Metalloproteinases 4,5, and 6 in Mouse Corneas Infected with P. Aeruginosa," *Invest Opthalmol Vis Sci* —42(13):3223- (2001) Abstract.

Duchrow, M., et al., "Assessment of Proliferative Activity in Colorectal Carcinomas by Quantitative Reverse Transcriptase-Polymerase Chain Reaction (RT-PCR)," *Cancer Invest.*—19(6):588-96 (2001) Abstract.

Dyer, J., et al., "Molecular Characterisation of Carbohydrate Digestion and Absorption in Equine Small Intestine," *Equine Vet J.*—34(4):349-58 (2002) Abstract.

Egwuagu, C.E., et al., "Suppressors of Cytokine Signaling Proteins are Differentially Expressed in Th1 and Th2 Cells Implications for Th Cell Lineage Commitment and Maintenance," *J Immunol.*—168(7):3181-7 (2002) Abstract.

El-Ghrably, I.A., et al., "Intravitreal Invading Cells Contribute to Vitreal Cytokine Milleu in Proliferative Vitreoretinopathy," *Br J Opthalmol.*—85(4):461-70 (2001) Abstract.

Eleore, L., et al., "Modulation of the Glutamatergic Receptors (AMPA and NMDA) and of Glutamate Vesicular Transporter 2 in the Rat Facial Nucleus after Axotomy," *Neuroscience* —136(1):147-60 (2005) Abstract.

Forsberg, H., et al., "Altered Levels of Scavenging Enzymes in Embryos Subjected to a Diabetic Environment," *Free Radic Res.*—24(6):451-9 (1966) Abstract.

Freyschuss, B., et al., "Induction of the Estrogen Receptor by Growth Hormone and Glucocorticoid Substitution in Priminary Cultures of Rat Hepatocytes," *Endocrinology* —133(4):1548-54 (1993) Abstract.

Fu, K., et al., "Cyclin D1-Negative Mantle cell Lymphoma: A Clinocopathologic Study Based on Gene Expression Profiling," *Blood* —106(13):4315-21 (2005) Abstract.

Fuchs, A.R., et al., "Oxytocin Receptors in Bovine Cervix: Distribution and Gene Expression During the Estrous Cycle," *Biol Reprod.* —54(3):700-8 (1996) Abstract.

Furuta, J., et al., "Silencing of the Thrombomodulin Gene in Human Malignant Melanoma," *Melanoma Res.* —15(1):15-20 (2005) Abstract.

Futcher, B., et al., "A Sampling of the Yeast Proteome," *Mol Cell Biol.*, —19(11):7357-68 (1999) Abstract.

George, J., et al., "Pre-translational Regulation of Cytochrome P450 Genes is Responsible for Disease-Specific Changes of Individual P450 Enzymes Among Patients with Cirrhosis," *Biochem Pharmacol.*—49(7):873-81 (1995) Abstract.

Giroux, M., et al., "Cyclooxygenase-2 Expression in Macrophages: Modulation by Protein Kinase C-alpha," *J immunol.*—165(7):3985-91 (2000) Abstract.

Gnatenko, D.V., et al., "Transcript Profiling of Human Platelets Using Microarray and Serial Analysis of Gene Expression," *Blood* —101(6):2285-93 (2003) Abstract.

Godbout, R., et al., "Overexpression of DEAD Box Protein (DDX1) in Neuroblastoma and Retinoblastoma Cell Lines," *J Biol Chem*,—273(33):21161-8 (1998) Abstract.

Goldenberg, R.C., et al., "Modulation of Gap Junction Mediated Intercellular Communication in TM3 Leydig Cells," *J Endocrinol.*—177(2):327-35 (2003) Abstract.

Golebiowski, F., et al., "Expression Level of Ubc9 Protein in Rat Tissues," *Acta Biochim Pol.*—50(4):1065-73 (2003) Abstract.

Grem, J.L., et al., "Thymidine Kinase, Thymidylate Synthase, and Dihydropyrimidine Dehydrogenase Profiles of Cell Lines of the National Cancer Institute's Anticancer Drug Screen," *Clin Cancer Res.*—7(4):999-1009 (2001) Abstract, Grenback, E., et al., "Galanin Pituitary Adenomas," *Regul Pept*,—117(2):127-39 (2004) Abstract.

Gromova, I., et al., "Protein Abundance and mRNA Levels of the Adipocyte-Type Fatty Acid Binding Protein Correlate in Non-Invasive and Invasive Bladder Transitional Cell Carcinomas," *Int J. Oncol.*— 13(2):379-83 (1998) Abstract.

Guo, Y., et al., "The Pathogenic Role of Macrophage Migration Inhibitory Factor in Acute Respiratory Distress Syndrome," *Zhinghua Jie He He Hu Xi Za Zhi*—25(6):337-70 (2002) Abstract.

Habu, Y., et al., "Restored Expression and Activity of Organic Ion Transporters rOAT1, rOAT3 and rOCT2 after Hyperuricemia in the Rat Kidney," *Biochem Pharmacol* —69(6):993-9 (2005) Abstract.

Hahn, M.E., et al., "Regulation of Cytochrome P4501A1 in Teleosts: Sustained Induction of CYP1A1 mRNA, Protein, and Catalytic Activity by 2,3,7,8-Tetrachlorodibenzofuran in the Marine Fish Stenotomus Chrysops," *Toxicol Appl Pharmacol.*—127(2):187-98 (1994) Abstract.

Hahnel, R., et al., "Expression of the pS2 Gene in Breast Tissues Assessed by pS2-mRNA Analysis and pS2-Protein Radioimmunoassay," *Breast Cancer Res Treat.*—24(1):71-4 (1992) Abstract.

Hamilton, L.M., et al., "The role of the Epidermal Growth Factor Receptor in Sustaining Neutrophil Inflammation in Severe Asthma," *Clin Exp Allergy.*—33(2):233-40 (2003) Abstract.

Hassett, C., et al., "Human Hepatic Microsomal Epoxide Hydrolase: Comparative Analysis of Polymorphic Expression," *Arch Biochem Biophys.*—337(2):275-83 (1997) Abstract.

Holten-Andersen, M.N., et al., "Localization of Tissue Inhibitor of Metalloproteinases 1 (TIMP-1) in Human Colorectal Adenoma and Adenocarcinoma," *Int J Cance,*—113(2):198-206 (2005) Abstract.

Huang, Y.H., et al., "Tissue Plasminogen Activator Induced by Dengue Virus Infection of Human Endothelial Cells," *J Med Virol.*—70(4):610-6 (2003) Abstract.

Huettner, P.C., et al., "Neu Oncogene Expression in Ovarian Tumors: A Quantitative Study," *Mod Pathol.*—5(3):250-6 (1992) Abstract.

Hui, P., et al., "Real-time Quantitative RT-PCR of Cyclin D1 mRNA in Mantle Cell Lymphoma: Comparison with FISH and Immunohistochemistry," *Leuk Lymphoma.* 44(8):1385-94 (2003) Abstract.

Husain, I., et al., "Elevation of Topoisomerase I Messenger RNA, Protein, and Catalytic Activity in Human Tumors: Demonstration of Tumor-Type Specificity and Implications for Cancer Chemotherapy," *Cancer Res.*—54(2):539-46 (1994) Abstract.

Ihmann, T., et al., "High-level mRNA Quantification of Proliferation Marker pKi-67 is Correlated with Favorable Prognosis in Colorectal Carcinoma," *J Cancer Res Clin Oncol.*—130(12):749-56 (2004) Abstract.

Ikegami, T., et al., "Modulation of Glucagon Receptor Expression and Response in Transfected Human Embryonic Kidney Cells," *Am J Physiol Cell Physiol.*—281(4):C1396-402 (2001) Abstract.

Jacquemin, E., et al., "Developmental Regulation of Acidic Fibroblast Growth Factor (aFGF) Expression in Bovine Retina," *Int J Biol.*—37(3):417-23 (1993) Abstract.

Jaime, M., et al., "The p21 (Cip1) Protein, A Cyclin Inhibitor, Regulates the Levels and the Intracellular Localization of CDC25A in Mice Regenerating Livers," *Hepatology* —35(5):1063-71 (2002) Abstract.

Janssens, N., et al., "Alteration of Frizzled Expression in renal Cell Carcinoma," *Tumour Biol.*—25(4):161-71 (2004) Abstract.

Jungbluth, A.A., et al., "Immunohistochemical Analysis of NY-ESO-1 Antigen Expression in Normal and Malignant Human Tissues," *Int J Cancer* —92(6):856-60 (2001) Abstract.

Kalabis, G.M., et al., "Multidrug Resistance Phosphoglycoprotein (ABCB1) in the Mouse Placenta: Fetal Protection," *Biol Reprod.*—73(4):591-7 (2005) Abstract.

Kammaori, M., et al., "Expression of Human Telomerase Reverse Transcriptase Gene and Protein, and of Estrogen amd Progesterone Receptors, in Breast Tumors: Preliminary Data from Neo-Adjuvant Chemotherapy," *Int J Oncol.*—27(5):1257-63 (2005) Abstract.

Khal, J., et al., "Expression of the Ubiquitin-Proteasome Pathway and Muscle Loss in Experimental Cancer Cachexi," *Br J Cancer* —93(7):774-80 (2005), Abstract.

Khal, J., et al., "Increased Expression of Proteasome Subunits in Skeletal Muscle of Cancer Patients with Weight Loss," Int *J. Biochem Cell Biol.*—37(10):2196-206 (2005) Abstract.

Kogo, H., et al., "Cell Type-Specific Occurrence of Caveolin-1alpha and-1beta in the Lung caused by Expression of Distinct mRNAs," *J Biol Chem.*—279(24):25574-81 (2004) Abstract.

Kommoss, F., et al., "Oncogene and Growth Factor Expression in Ovarian Cancer," *Acta Obstet Gynecol Scand Suppl.*—155:19-24 (1992) Abstract.

Kumar, U., et al., "Somatostatin Receptors in Primary Human Breast Cancer: Quantitative Analysis of mRNA for Subtypes 1-5 and Correlation with Receptor Protein Expression and Tumor Pathology," *Breast Cancer Res. Treat.*—92(2):175-86 (2005) Abstract.

Kuo, C.C., et al., "A Transcriptomic and Proteomic Analysis of the Effect of CpG-ODN on Human THP-1 Monocytic Leukemia Cells," *Proteomics* —5(4):894-906 (2005) Abstract.

Landmark, B.F., et al., "Cellular Location and Age-dependent Changes of the regulatory Subunits of cAMP-dependent Protein Kinase in Rat Testis," *J Reprod Fertil.*—99(2):323-34 (1993) Abstract.

Lassmann, S., et al., "Quantification of CK20 Gene and Protein Expression in Colorectal Cancer by RT-PCR and Immunohistochemistry Reveals Inter- and Intratumour Heterogeneity," *J Pathol.*—198(2):198-206 (2002) Abstract.

Legrand, O., et al., "Expression of the Multidrug Resistance-Associated Protein (MRP) mRNA and Protein in Normal Peripheral Blood and Bone Marrow Haemopoietic Cells," *Br J, Haematol.*—94(1):23-33 (1996) Abstract.

Lemstrom, K.B., et al., "Vascular Endothelial Growth Factor Enhances Cardiac Allograft Arteriosclerosis," *Circulation*—105(21):2524-30 (2002) Abstract.

Li, Z.B., et al., "Enhanced Expressions of Arachidonic Acid-Sensitive Tandem-Pore Domain Potassium Channels in Rat Experimental Acute Cerebral Ischemia," *Biochem Biophys Res Commun.*—327(4):1163-9 (2005) Abstract.

Li, Y., et al., "Retinal Preconditioning and the Induction of Heat-Shock Protein 27," *Invest Ophthalmol Vis Sci.*—44(3):1299-304 (2003) Abstract.

Lindberg, P., et al., "Increasing Expression of Tissue Plasminogen Activator and Plasminogen Activator Inhibitor Type 2 in Dog Gingival Tissues with Progressive Inflammation," *Arch Oral Biol.*—46(1):23-31 (2001) Abstract.

Macabeo-Ong, M., et al., "Effect of Duration of Fixation on Quantitative Reverse Transcription Polymerase Chain Reaction Analyses," 15(9):979-87 (2002) Abstract.

Maruyama, H., et al., "Id-1 and Id-2 are Overexpressed in Pancreatic Cancer and in Dysplastic Lesions in Chronic Pancreatitis," *Am J Pathol.*—155(3):815-22 (1999) Abstract.

Meehan, T.P., et al., "Tightly Regulated and Inducible Expression of a Yoked Hormone-Receptor Complex in HEK 293 Cells," *J Mol Endocrinol.*—32(1):247-55 (2004) Abstract.

Mendoza-Rodriguez, C.A., et al., "C-fos and Estrogen Receptor Gene Expression Pattern in the Rat Uterine Epithelium During the Estrous Cycle," *Mol Reprod Dev.* 64(4):379-88 (2003) Abstract.

Meoni, P., et al., "[3H]MK-801 Binding and the mRNA for the NMDARI Subunit of the NMDA Receptor are Differentially Distributed in Human and Rat Forebrain," *Brain Res Mol Res.*—54(1):13-23 (1998) Abstract.

Mezzano, S.A., et al., "Overexpression of Chemokines, Fibrogenic Cytokines, and Myofibroblasts in Human Membranous Nephropathy," *Kiney Int.*—57(1):147-58 (2000) Abstract.

Mingrone, G., et al., "Decreased Uncoupling Protein Expression and Intramyocytic Triglyceride Depletion in Formerly Obese Subjects," *Obes Res.*—11(5):632-40 (2003) Abstract.

Miralles, C.P., et al., "Differential Expression of the Short and Long Forms of the Gamma 2 Subunit of the GABAA/benzodiazepine Receptors," *Brain Res Mol Res.*—24(1-4):129-39 (1994) Abstract.

Mizrachi, D., et al.,"Follicle-stimulating Hormone Receptor and Its Messenger Ribonucleic Acid are Present in the Bovine Cervix and Can Regulate Cervical Prostanoid Synthesis," *Biol Reprod.*—61(3):776-84 (1999) Abstract.

Monaghan, P., et al., "The Alpha(v)beta6 Integrin Receptor for Foot-and-Mouth Disease Virus is Expressed Constitutively on the Epithelial Cells Targeted in Cattle," *J Gen Virol.*—86(Pt 10):2769-80 (2005) Abstract.

Montuori, N., et al., "Urokinase-Mediated Posttranscriptional Regualtion of Urokinase-Receptor Expression in Non Small Cell Lung Carcinoma," *Int J Cancer* —105(3):353-60 (2003) Abstract.

Munaut , C.,et al., "Vascular Endothelial Growth Factor Expression Correlates with Matrix Metalloproteinases MT1-MMP, MMP-2 and MMP-9 in Human Glioblastomas," *Int J Cancer* —106(6):848-55 (2003) Abstract.

Nie, Y., et al., "DNA Hypermethylation is a Mechanism for Loss of Expression of the HLA Class I Genes in Human Esophageal Squamous Cell Carcinomas," *Carcinogenesis* —22(10):1615-23 (2001) Abstract.

Nuciforo, P.G., et al., "Molecular and Immunohistochemical Analysis of HER2/neu Oncogene in Synovial Sarcoma," *Hum Pathol.*—34(7):639-45 (2003) Abstract.

Oberringer, M., et al., "Differential Expression of Heat Shock Protein 70 in Well Healing and Chronic Human Wound Tissue," *Biochem Biophys Res Commun.*—214(3):1009-14 (1995) Abstract.

Orntoft, T.F., et al., "Genome-wide Study of Gene Copy Numbers, Transcripts, and Proteins Levels in Pairs of Non-Invasive and Invasive Human Transitional Cell Carcinomas," *Mol Cell Proteomics.*—1(1):37-45 (2002) Abstract.

Orntoft, T.F., et al., "Genome-Wide Study of Gene Copy Numbers, Transcripts, and Protein Levels in Pairs of Non-Invasive and Invasive Human Transitional Cell Carcinomas," *Molecular & Cellular Proteomics* —1:37-45 (2002).

Pachmann, K., et al., "Expression of bcr-abl mRNA in Individual Chronic Myelogenous Leukaemia Cells as determined by in Situ Amplification," *Br J. Haematol* —112(3):749-59 (2001) Abstract.

Pairon, J.C., et al., "Cell Localization and Regulation of Expression of Cytochrome P450 1A1 and 2B1 in Rat Lung after Induction with 3-Methylcholanthrene Using mRNA Hybridization and Immunohistochemistry," *Am J Respir Cell Mol Biol.*—11(4):386-96 (1994) Abstract.

Papotti, M., et al., "Correlative Immunohistochemical and Reverse Transcriptase Polymerase Chain Reaction Analysis of Somatostatin Receptor Type 2 in Neuroendocrine Tumors of the Lung," *Diagn Mol Pathol.*—9(1):47-57 (2000) Abstract.

Papotti, M., et al., "Expression of Somatostatin Receptor Types 1-5 in 81 Cases if Gastrointestinal and Pancreatic Endocrine Tumors. A correlative Immunohistochemical and Reverse-Transcriptase Polymerase Chain Reaction Analysis," *Virchows Arch.*—440(5):461-75 (2002) Abstract.

Paredes, J., et al., "P-Cadherin Overexpression is an indicator of Clinical Outcome in Invasive Breast Carcinomas and is Associated with CDH3 Promoter Hypomethylation," *Clin Cancer Res.*—11(16):5869-77 (2005) Abstract.

Politis, I., et al., "Mammary-Derived Growth Inhibitor Protein and Messenger Ribonucleic Acid Concentration in Different Physiological States of the Gland," *J Dairy Sci.*—75(6):1423-9 (1992) Abstract.

Preesman, A.H., et al., "T-Cell Receptor V Beta-family Usage in Primary Cutaneous and Primary Nodal T-cell non-Hodgkin's Lymphomas," *J Invest Dermatol.*—99(5):587-93 (1992) Abstract.

Pullig, O., et al., "Matrilin-3 in Human Articular Cartilage: Increased Expression in Osteoarthritis," *Osteoarthritis Cartilage* —10(4):253-63 (2002) Abstract.

Rey, C., et al., "Up-regulation of Mitochondrial Peripheral Benzodiazepine Receptor Expression by Tumor Necrosis Factor Alpha in Testicular Leydig Cells. Possible Involvement in Cell Survival," *Biochem Pharmacol.*—60(11):1636-46 (2000) Abstract.

Rudlowski, C., et al., "GLUT1 Messenger RNA and Protein Induction Rrelates to the Malignant Transformation of Cervical Cancer," *Am J. Clin Pathol.*—120(5):691-8 (2003) Abstract.

Sasaki, T., et al., "Expression and Distribution of Laminin Alpha1 and Alpha2 Chains in Embryonic and Adult Mouse Tissues: An Immunochemical Approach," *Exp Cell Res.*—275(2):189-99 (2002) Abstract.

Sedelies, K.A., et al., "Discordant Regulation of Granzyme H and Granzyme B Expression in Human Lymphocytes," *J Biol Chem.*—279(25):26581-7 (2004) Abstract.

Shen, Y., et al., "BCL2 Protein Expression Parallels its mRNA level in normal and Maligent B Cells," *Blood* —104(9):2936-9 (2004) Abstract.

Shinohara, Y., et al., "Quantitative Determinations of the Steady Transcript Levels of Hexokinase Isozymes and Glucose Transporter Isoforms in Normal Rat Tissues and the Malignant Tumor Cell Line AH130," *Biochim Biophys Acta* —1368(1):129-36 (1998) Abstract.

Silvers, A.L., et al., "UVA Irradiation-Induced Activation of Activator Protein-1 is Correlated with Induced Expression of AP-1 Family Memebers in the Human Keratinocyte Cell Line HaCat," *Photochem Photbiol.*—75(3):302-10 (2002) Abstract.

Song, L., et al., "Rat Kidney Glutamyl Aminopeptidase (aminopeptidase A): Molecular Identity and Cellular Localization," *Am J. Physiol.*—267(4Pt 2):F546-57 (1994) Abstract.

Spaziani, E.P., et al., "Tumor Necrosis Factor-Alpha Upregulates the Prostaglandin E2 EP1 Receptor Subtype and the Cyclooxgenase-2 Isoform in Cultured Amnion WISH Cells," *J Interferon Cytokine Res.*—18(12):1039-44 (1998) Abstract.

Spika, I., et al., "Transcriptional Activity of Potent Glucocorticoids: Revelance of Glucocorticord Receptor Isoforms and Drug Metabolites," *Skin Pharmacol Appl Skin Physiol.*—16(3):143-50 (2003) Abstract.

Splinter, P.L., et al., "Specific Inhibition of AQP1 Water Channels in Isolated Rat Intrahepatic Bile Duct Units by Small Interfering RNAs," *J Biol Chem* —278(8):6268-74 (2003) Abstract.

Stearns, M.E., et al., "Type IV Collagenase (M(r) 72,000) Expression in Human Prostate: Benign and Malignant Tissue," *Cancer Res.*—53(4):878-83 (1993) Abstract.

Stein, R., et al., "The Decompensated Detrusor III: Impact of Bladder Outlet Obstruction on Sarcoplasmic Endoplasmic Reticulum Protein and Gene Expression," *J Urol.*—164(3Pt 2):1026-30 (2000) Abstract.

Strickland, I., et al. ,"TNF-Alpha and IL-8 are Upregulated in the Epidermis of Normal Human Skin after UVB Exposure: Correlation with Nuetrophil Accumulation and E-Selectin Expression," *J Invest Dermatol.*—108(5):763-8 (1997) Abstract.

Strutz, F., et al., "Basic Fibroblast Growth Factor Expression is Increased in Human Renal Fibrogenesis and May Mediate Acutocrine Fibroblast Proliferation," *Kidney Int.*—57(4):1521-38 (2000) Abstract.

Takahashi, K., et al., "Adiposity Elevates Plasma MCP-1 Levels Leading to the Increased CD11b-Positive Monocytes in Mice," *J Biol. Chem.*—278(47):46654-60 (2003) Abstract.

Takimoto, Y., et al., "Augmented Expression of Neuronal Nitric Oxide Synthase in the Atria Parasympthetically Decreases Heart Rate During Acute Myocardial Infarction in Rats," *Circulation* —105(4):490-6 (2002) Abstract.

Telek, G., et al., "Differential Upregulation of Cellular Adhesion Molecules at the Sites of Oxidative Stress in Experimental Acute Pancreatitis," *J Surg Res.*—96(1):56-67 (2001) Abstract.

Timchenko, L., et al., "Myotonic Dystrophy: An Unstable CTG Repeat in a Protein Kinase Gene," *Semin Cell Biol.*—6(1):13-9 (1995) Abstract.

Torronen, R., et al., "Induction of Class 3 Aldehyde Dehydrogenase in the Mouse Hepatoma Cell Line Hepa-1 by Various Chemicals," *Chem Biol. Interact.*—83(2):107-19 (1992) Abstract.

Ullmannova, V., et al., "Relationship Between Cyclin D1 and p21 (Waf1/Cip1) During Differentiation of Human Myeloid Leukemia Cell Lines," *Leuk Res.*—27(12):1115-23 (2003) Abstract.

Van Beers, E.H., et al., "Intestinal Carbamoyl Phosphate Synthase I in Human and Rat. Expression during Development Shows Species Differences and Mosaic Expression in Duodenum of Both Species," *J Histochem Cytochem.*—46(2):231-40 (1998) Abstract.

Van Der Wilt, C.L., et al., "Expression of Deoxycytidine Kinase in Leukaemic Cells Compared with Solid Tumour Cell Lines, Liver Metastases and Normal Liver," *Eur J Cancer*—39(5):691-7 (2003) Abstract.

Waldherr, R., et al., "Expression of Cytokines and Growth Factors in Human Glomerulonephritides," *Pediatr Nephrol.*—7(4):471-8 (1993) Abstract.

Walmer, D.K., et al., "Malignant Transformation of the Human Endometrium is associated with Overexpression of Lactoferrin Messenger RNA and Protein," *Cancer Res.*—55(5):1168-75 (1995) Abstract.

Wang, J., et al., "Cell Proliferation in Human Soft Tissue Tumors Correlates with Platelet-derived Growth Factor B Chain Expression: An Immunohistochemical and in Situ Hybridization Study," *Cancer Res.*—54(2):560-4 (1994) Abstract.

Wang, J., et al., "Expression of Cadherins and Catenins in Paired Tumor and Non-neoplastic Primary Prostate Cultures and Corresponding Prostatectomy Specimens," *Urol Res.*—28(5):308-15 (2000) Abstract.

Wang, L.G., et al., "Down-Regulation of Prostate-Specific Antigen Expression by Finasteride through Inhibition of Complex Formation Between Androgen Receptor and Steroid Receptor-binding Consensus in the Promoter of the PSA Gene in LNCaP Cells," *Cancer Res.*—57(4):714-9 (1997) Abstract.

Weterman, M.A., et al., "Expression of Calcyclin in Human Melanocytic Lesions," *Cancer Res.*—53(24):6061-6 (1993) Abstract.

Williams, E.T., et al., "Estrogen Regulation of the Cytochrome P450 3A Subfamily in Humans," J Pharmacol Exp Ther. 311(2):728-35 (2004) Abstract.

Wojtaszek, P.A., et al., "Severely Decreased MARCKS Expression Correlates with Ras Reversion but not with Mitogenic Responsiveness" *Oncogene*—8(3):755-60 (1993) Abstract.

Zhong, W., et al., "Expression of Superoxide Dismutases, Catalase, and Glutathione Peroxidase in Glioma Cells," *Free Radic Biol Med.*—27(11-12):1334-45 (1999) Abstract.

Xi, L., et al., "Expression of Human Telomerase Reverse Transcriptase in Cervix Cancer and its Significance," Zhonghua Fu Chan Ke Za Zhi—40(6):407-10 (2005) Abstract.

Alberts, B., et al., Molecular Biology of the Cell (3$^{rd}$ ed. 1994) Cell 3$^{rd}$ at 453 Figure 9-2 of Cell 3$^{rd}$ at 403.

Alberts, B., et al., Molecular Biology of the Cell (4$^{rd}$ ed.) In Cell 4$^{th}$, Figure 6-3 on p. 302 Figure 6-90 on p. 364 of Cell 4$^{th}$ Cell 4$^{th}$ at 364 Cell 4at 379.

Aust, G., et al., "Human Throid Carcinoma Cell Lines and Normal Thyrocytes: Expression and Regulation of Matrix Metalloproteinase-1 and Tissue Matrix Metalloproteinase Inhibitor- Messenger-RNA and Protein," *Thyroid*—7(5):713-724 (1997).

Beà, S., et al., "BMI-1 Gene Amplification and Overexpression in Hematological Malignancies Occur Mainly in Mantle Cell Lymphomas," *Cancer Research*—61:2409-2412 (2001).

Beer, et al, "Gene-expression profiles predict survival of patients with lung adenocarcinoma," *Nature Biomedicine*—98(6):816-824 (2002).

Futcher, B., et al., "A Sampling of the Yeast Proteome," *Molecular and Cellular Biology*—19(11):7357-7368 (1999).

Greenbaum, D., et al., "Analysis of mRNA Expression and Protein Abundance Data: An Approach for the Comparison of the Enrichment of Features In the Cellular Population of Proteins and Transcripts," *Bioinformatics1*—18(4):585-496 (2002).

Gromova, I., et al., "Protein Abundancy and mRNA Levels of the Adipocyte-Type Fatty Acid Binding Protein Correlate in Non-Invasive and Invasive Bladder Transitional Cell Carcinomas," *International Journal of Oncology*—13(2) 6 pages (1998).

Hähnel, E., et al., "Expression of the pS2 Gene in Breast Tissues Assessed by pS2-mRNA Analysis and pS2-Protein Radioimmunoassay," *Breast Cancer Research and Treatment*—24:71-74 (1992).

Hirsch, F.R., et al., "Early Detection of Lung Cancer: Clinical Perspectives of Recent Advances in Biology and Radiology," *Clinical Cancer Research*—7:5-22 (2001).

Holten-Andersen, M.D., et al., "Localization of Tissue Inhibitor of Metalloproteinases 1 (TIMP-1) in Human Colorectal Adenoma and Adenocarcinoma," *Int. J. Cancer1*—113:198-206 (2005).

Kammori, M., et al., "Expression of Human Telomerase Reverse Transcriptase Gene and Protein, and of Estrogen and Progesterone Receptors, in Breast Tumors: Preliminary Data from Neo-Adjuvant Chemotherapy", International *Journal of Oncology*—27(5) (2005).

Lewin, B., Genes VI (1997 Genes VI at 847-848.

Meric, F., et al., "Translation Initiation in Cancer: A Novel Target for Therapy," *Molecular Cancer Therapeutics*—1:971-979 (2002).

Munaut, C., et al., "Vascular Endothelial Growth Factor Expression Correlates With Matrix Metalloproteinases MT1-NMP, MNP-2 and NMP-9 in Human Glioblastomas," *Int. J. Cancer*—106:848-855 (2003).

Nuciforo, P. G., et al., "Molecular and Immunohistochemical Analysis of HER2/neu Oncogene in Synovial Sarcoma," *Human Pathology*—34(7):639-645 (2003).

Walmer, D. K., et al., "Malignant Transformation of the Human Endometrium is Associated with Overexpression of Lactoferrin Messenger RNA and Protein," *Cancer Research*—55(5):1168-1174 (1995).

Zhigang, Z., et al., "Prostate Stem Cell Antigen (PSCA) Express in Human Prostate Cancer Tissues and its Potential Role in Prostate Carinogenesis and Progession of Prostate Cancer," *World Journal of Surgical Oncology*—2-13 (2004).

Golub, T.R., et al., "Molecular Classification of Cancer: Class Discovery and Class Prediction by Gene Expression Monitoring," *Science*—286:531-537 (1999).

Wen-Hsiang, W., et al., "Comparison of *TP53* Mutations Indentified by Oligonucleotide Microarray and Conventional DNA Sequence Analysis," *Cancer Research*—60:2716-2722 (2000).

MAQC Consortium, "The MicroArray Quality Control (MAQC) Project shows inter- and intraplatform reproducibility of gene expression measurements," Nature Biotechnology 24:1151-1161 (2006).

\* cited by examiner

FIGURE 1A

```
GCAGCCCTAGCAGGGATGGACATGATGCTGTTGGTGCAGGGTGCTTGTTGCTCGAACCAGTG
GCTGGCGGCGGTGCTCCTCAGCCTGTGCTGCCTGCTACCCTCCTGCCTCCCGGCTGGACAGA
GTGTGGACTTCCCCTGGGCGGCCGTGGACAACATGATGGTCAGAAAAGGGGACACGGCGGTG
CTTAGGTGTTATTTGGAAGATGGAGCTTCAAAGGGTGCCTGGCTGAACCGGTCAAGTATTAT
TTTTGCGGGAGGTGATAAGTGGTCAGTGGATCCTCGAGTTTCAATTTCAACATTGAATAAAA
GGGACTACAGCCTCCAGATACAGAATGTAGATGTGACAGATGATGGCCCATACACGTGTTCT
GTTCAGACTCAACATACACCCAGAACAATGCAGGTGCATCTAACTGTGCAAGTTCCTCCTAA
GATATATGACATCTCAAATGATATGACCGTCAATGAAGGAACCAACGTCACTCTTACTTGTT
TGGCCACTGGGAAACCAGAGCCTTCCATTTCTTGGCGACACATCTCCCCATCAGCAAAACCA
TTTGAAAATGGACAATATTTGGACATTTATGGAATTACAAGGGACCAGGCTGGGGAATATGA
ATGCAGTGCGGAAAATGATGTGTCATTCCCAGATGTGAGGAAAGTAAAGTTGTTGTCAACT
TTGCTCCTACTATTCAGGAAATTAAATCTGGCACCGTGACCCCCGGACGCAGTGGCCTGATA
AGATGTGAAGGTGCAGGTGTGCCGCCTCCAGCCTTTGAATGGTACAAAGGAGAGAAGAAGCT
CTTCAATGGCCAACAAGGAATTATTATTCAAAATTTTAGCACAAGATCCATTCTCACTGTTA
CCAACGTGACACAGGAGCACTTCGGCAATTATACTTGTGTGGCTGCCAACAAGCTAGGCACA
ACCAATGCGAGCCTGCCTCTTAACCCTCCAAGTACAGCCCAGTATGGAATTACCGGGAGCGC
TGATGTTCTTTTCTCCTGCTGGTACCTTGTTGACACTGTCCTCTTTCACCAGCATATTCT
ACCTGAAGAATGCCATTCTACAATAAATTCAAAGACCCATAAAAGGCTTTTAAGGATTCTCT
GAAAGTGCTGATGGCTGGATCCAATCTGGTACAGTTTGTTAAAAGCAGCGTGGGATATAATC
AGCAGTGCTTACATGGGGATGATCGCCTTCTGTAGAATTGCTCATTATGTAAATACTTTAAT
TCTACTCTTTTTTGATTAGCTACATTACCTTGTGAAGCAGTACACATTGTCCTTTTTTAAG
ACGTGAAAGCTCTGAAATTACTTTTAGAGGATATTAATTGTGATTTCATGTTTGTAATCTAC
AACTTTTCAAAAGCATTCAGTCATGGTCTGCTAGGTTGCAGGCTGTAGTTTACAAAAACGAA
TATTGCAGTGAATATGTGATTCTTTAAGGCTGCAATACAAGCATTCAGTTCCCTGTTTCAAT
AAGAGTCAATCCACATTTACAAAGATGCATTTTTTCTTTTTGATAAAAAAGCAAATAATA
TTGCCTTCAGATTATTTCTTCAAAATATAACACATATCTAGATTTTTCTGCTCGCATGATAT
TCAGGTTTCAGGAATGAGCCTTGTAATATAACTGGCTGTGCAGCTCTGCTTCTCTTTCCTGT
AAGTTCAGCATGGGTGTGCCTTCATACAATAATATTTTCTCTTTGTCTCCAACTAATATAA
AATGTTTTGCTAAATCTTACAATTTGAAAGTAAAAATAAACCAGAGTGATCAAGTTAAACCA
TACACTATCTCTAAGTAACGAAGGAGCTATTGGACTGTAAAAATCTCTTCCTGCACTGACAA
TGGGGTTTGAGAATTTTGCCCCACACTAACTCAGTTCTTGTGATGAGAGACAATTTAATAAC
AGTATAGTAAATATACCATATGATTTCTTTAGTTGTAGCTAAATGTTAGATCCACCGTGGGA
AATCATTCCCTTTAAAATGACAGCACAGTCCACTCAAAGGATTGCCTAGCAATACAGCATCT
TTTCCTTTCACTAGTCCAAGCCAAAAATTTTAAGATGATTTGTCAGAAAGGGCACAAAGTCC
TATCACCTAATATTACAAGAGTTGGTAAGCGCTCATCATTAATTTTATTTTGTGGCAGCTAA
GTTAGTATGACAGAGGCAGTGCTCCTGTGGACAGGAGCATTTTGCATATTTTCCATCTGAAA
GTATCACTCAGTTGATAGTCTGGAATGCATGTTATATATTTTAAAACTTCCAAAATATATTA
TAACAAACATTCTATATCGGTATGTAGCAGACCAATCTCTAAAATAGCTAATTCTTCAATAA
AATCTTTCTATATAGCCATTTCAGTGCAAACAAGTAAAATCAAAAAAGACCATCCTTTATTT
TTCCTTACATGATATATGTAAGATGCGATCAAATAAAGACAAAACACCAGTGATGAGAATAT
CTTAAGATAAGTAATTATCAAATTATTGTGAATGTTAAATTATTTCTACTATAAAGAAGCAA
AACTACATTTTTGAAGGAAATGCTGTTACTCTAACATTAATTTACAGGAATAGTTTGATGG
TTTCACTCTTTACTAAAGAAAGGCCATCACCTTGAAAGCCATTTTACAGGTTTGATGAAGTT
ACCAATTTCAGTACACCTAAATTTCTACAAATAGTCCCCTTTTACAAGTTGTAACAACAAAG
ACCCTATAATAAAATTAGATACAAGAAATTTTGCAGTGGTTATACATATTTGAGATATCTAG
TATGTTGCCCTAGCAGGGATGGCTTAAAAACTGTGATTTTTTTCTTCAAGTAAAACTTAGT
CCCAAAGTACATCATAAATCAATTTTAATTAGAAAATGAATCTTAAATGAGGGGACATAAG
TATACTCTTTCCACAAAATGGCAATAATAAGGCATAAAGCTAGTAAATCTACTAACTGTAAT
AAATGTATGACATTATTTTGATTGATACATTAAAAAGAGTTTTTAGAACAAATATGGCATT
TAACTTTATTATTTATTTGCTTTTAAGAAATATTCTTTGTGGAATTGTTGAATAAACTATAA
AATATTATTTTGTATTGCAGCTTTAAAGTGGCACACTCCATAATAATCTACTTACTAGAAAT
```

FIGURE 1B

```
AGTGGTGCTACCACAAAAAATGTTAACCATCAGTACCATTGTTTGGGAGAAAGAAACAGATC
AAGAATGCATATTATTCAGTGACCGCTTTCCTAGAGTTAAAATACCTCCTCTTTGTAAGGTT
TGTAGGTAAATTGAGGTATAAACTATGGATGAACCAAATAATTAGTTCAAAGTGTTGTCATG
ATTCCAAATTTGTGGAGTCTGGTGTTTTTACCATAGAATGTGACAGAAGTACAGTCATAGCT
CAGTAGCTATATGTATTTGCCTTTATGTTAGAAGAGACTTTCTTGAGTGACATTTTTAAATA
GAGGAGGTATTCACTATGTTTTCTGTATCACAGCAGCATTCCTAGTCCTTAGGCCCTCGGA
CAGAGTGAAATCATGAGTATTTATGAGTTCAATATTGTCAAATAAGGCTACAGTATTTGCTT
TTTTGTGTGAATGTATTGCATATAATGTTCAAGTAGATGATTTTACATTTATGGACATATAA
AATGTCTGATTACCCCATTTTATCAGTCCTGACTGTACAAGATTGTTGCAATTTCAGAATAG
CAGTTTTATAAATTGATTTATCTTTTAATCTATAACAATTTGTGTTAGCTGTTCATTTCAGG
ANTATATTTTCTACAAGTTCCACTTGTGGGACTCCTTTTGTTGCCCCTATTTTTTTTAAAG
AAGGAAGAAAGAAAAATAAGTAGCAGTTTAAAAATGAGAATGGAGAGAAAAGAAAAAGAATG
AAAAGGAAAGGCAGTAAAGAGGGAAAAAAAAGGAAGGATGGAAGGAATGAAGGAAGGAAGGG
AGGAAGGGGAGAAGGTAGGAAGAAAGAAAGGATGAGAGGGAAGGAAGAATCAGAGTATTAGG
GTAGTTAACTTACACATTTGCATTCTTAGTTTAACTGCAAGTGGTGTAACTATGTTTTTCAA
TGATCGCATTTGAAACATAAGTCCTATTATACCATTAAGTTCCTATTATGCAGCAATTATAT
AATAAAAAGTACTGCCCAAGTTATAGTAATGTGGGTGTTTTGAGACACTAAAAGATTTGAG
AGGGAGAATTTCAAACTTAAAGCCACTTTTGGGGGGTTTATAACTTAACTGAAAAATTAATG
CTTCATCATAACATTTAAGCTATATCTAGAAAGTAGACTGGAGAACTGAGAAAATTACCCAG
GTAATTCAGGGAAAAAAAAAATATATATATATATAAATACCCCTACATTTGAAGTCAGAAA
ACTCTGAAAAACTGAATTATCAAAGTCAATCATCTATAATGATCAAATTTACTGAACAATTG
TTAATTTATCCATTGTGCTTAGCTTTGTCACACAGCCAAAAGTTACCTATTTAATCTTTTCA
ATAAAAATTGTTTTTTGAAATCCAGAAATGATTTAAAAAGAGGTCAGGTTTTTAACTATTTA
TTGAAGTATGTGGATGTACAGTATTTCAATAGATATGAATATGAATAAATGGTATGCCTTAA
GATTCTTTGAATATGTATTTACTTTAAAGACTGGAAAAAGCTCTTCCTGTCTTTTAGTAAAA
CATCCATATTTCATAACCTGATGTAAAATATGTTGTACTGTTTCCAATAGGTGAATATAAAC
TCAGTTTATCAATTAAAAAAAAAAAAAAAAAAAAAAAAAAAAAAAAAAAAAAAAAAAAAAAA
```

FIGURE 2

```
></usr/seqdb2/sst/DNA/Dnaseqs.full/ss.DNA92259
><subunit 1 of 1, 354 aa, 1 stop
><MW: 38719, pI: 6.12, NX(S/T): 6
MDMMLLVQGACCSNQWLAAVLLSLCCLLPSCLPAGQSVDFPWAAVDNMMVRKGDTAVLRCYL
EDGASKGAWLNRSSIIFAGGDKWSVDPRVSISTLNKRDYSLQIQNVDVTDDGPYTCSVQTQH
TPRTMQVHLTVQVPPKIYDISNDMTVNEGTNVTLTCLATGKPEPSISWRHISPSAKPFENGQ
YLDIYGITRDQAGEYECSAENDVSFPDVRKVKVVVNFAPTIQEIKSGTVTPGRSGLIRCEGA
GVPPPAFEWYKGEKKLFNGQQGIIIQNFSTRSILTVTNVTQEHFGNYTCVAANKLGTTNASL
PLNPPSTAQYGITGSADVLFSCWYLVLTLSSFTSIFYLKNAILQ
```

Important features of the protein:
Signal peptide:
amino acids 1-33

Transmembrane domain:
amino acids 322-343

N-glycosylation sites.
amino acids 73-77, 155-159, 275-279, 286-290, 294-298, 307-311

Tyrosine kinase phosphorylation site.
amino acids 180-188

N-myristoylation sites.
amino acids 9-15, 65-71, 69-75, 153-159, 241-247, 293-299, 304-310, 321-327

Myelin P0 protein.
amino acids 94-123

FIGURE 3

CACTGCCCGTCCGCTCTTCAGCAGCCGGTCGCGGGCGGTGGAAAAGCGAGTGAAGAGAGCGC
GACGGCGGCGGCGGCGGCGGCGCAGCTATTGCTGGACGGCCAGTGGGAGAGCGAGGCCTGAG
CCTCTGCGTCTAGGATCAAAATGGTTTCAATCCCAGAATACTATGAAGGCAAGAACGTCCTC
CTCACAGGAGCTACCGGTTTTCTAGGGAAGGTGCTTCTGGAAAAGTTGCTGAGGTCTTGTCC
TAAGGTGAATTCAGTATATGTTTTGGTGAGGCAGAAAGCTGGACAGACACCACAAGAGCGAG
TGGAAGAAGTCCTTAGTGGCAAGCTTTTTGACAGATTGAGAGATGAAAATCCAGATTTTACA
GAGAAAATTATAGCAATCAACAGCGAACTCACCCAACCTAAACTGGCTCTCAGTGAAGAAGA
TAAAGAGGTGATCATAGATTCTACCAATATTATATTCCACTGTGCAGCTACAGTAAGGTTTA
ATGAAAATTTAAGAGATGCTGTTCAGTTAAATGTGATTGCAACGCGACAGCTTATTCTCCTT
GCACAACAAATGAAGAATCTGGAAGTGTTCATGCATGTATCAACAGCATATGCCTACTGTAA
TCGCAAGCATATTGATGAAGTAGTCTATCCACCACCTGTGGATCCCAAGAAGCTGATTGATTCT
TTAGAGTGGATGGATGATGGCCTAGTAAATGATATCACGCCAAAATTGATAGGAGACAGACC
TAATACATACATATACACAAAAGCATTGGCAGAATATGTTGTACAACAAGAAGGAGCAAAAC
TAAATGTGGCAATTGTAAGGCCATCGATTGTTGGTGCCAGTTGGAAAGAACCTTTTCCAGGA
TGGATTGATAACTTTAATGGACCAAGTGGTCTCTTTATTGCGGCAGGGAAAGGAATTCTTCG
AACAATACGTGCCTCCAACAATGCCCTTGCAGATCTTGTTCCTGTAGATGTAGTTGTCAACA
TGAGTCTTGCGGCAGCCTGGTATTCCGGAGTTAATAGACCAAGAAACATCATGGTGTATAAT
TGTACAACAGGCAGCACTAATCCTTTCCACTGGGGTGAAGTTGAGTACCATGTAATTTCCAC
TTTCAAGAGGAATCCTCTCGAACAGGCCTTCAGACGGCCCAATGTAAATCTAACCTCCAATC
ATCTTTTATATCATTACTGGATTGCTGTAAGCCATAAGGCCCCAGCATTCCTGTATGATATC
TACCTCAGGATGACTGGAAGAAGCCCAAGGATGATGAAAACAATAACTCGTCTTCACAAAGC
TATGGTGTTTCTTGAATATTTCACAAGTAATTCTTGGGTTTGGAATACTGAGAATGTCAATA
TGTTAATGAATCAACTAAACCCTGAAGATAAAAAGACCTTCAATATTGATGTACGGCAGTTA
CATTGGGCAGAATATATAGAGAACTACTGCTTGGGAACTAAGAAGTACGTATTGAATGAAGA
AATGTCTGGCCTCCCTGCAGCCAGAAAACATCTGAACAAGTTGCGGAATATACGTTATGGTT
TTAATACTATCCTTGTGATCCTCATCTGGCGCATTTTTATTGCAAGATCACAAATGGCAAGA
AATATCTGGTACTTTGTGGTTAGTCTGTGTTACAAGTTTTTGTCATACTTCCGAGCATCCAG
CACTATGAGATACTGAAGACCAAGGATTCAGCATTAGAACATCTATACATATGGTGATCTAA
ATGTACAAAATGTAAATGTATAAGTCATCTCACTTTTTGTCAAGACATTAAACCATCTTAG
ATCGGAGTGTGAAGTAAATTATGGTATATTTATGTAACATTTTAATGTTTATGCTCATAAA
ACTTAGTGAACACACTGTGTTATGCCAGCTCAAATCTACAGTAGCCACCAAAACCATGACTT
AATATTTTGAGCCCTAGAAGAAAGGGGTGTGCTGAGGACAAGAGTGGGGAAATAGGAACACT
GACCAGTATAACTGTGCAATTCTGGAACATATTAATTAAAATAATATGCCTTAACATATAGT
GAATTTCTAATTCTAATGTTCAGTGCAATGGAAGACATTTATTTGGACAGTATACTAGCAAA
GTTGGTAGATATTTGATTCTTCATTTTTGTTTTTTCATTAGTTGAAGTGGGTTTTAGTTT
TGTTTAAAATTATAACCAGCGTATTTTCACATCATTCTGTAAGTTAAATGATATCAAACATG
AAAGAGATGTTCTCATTTTTCTTTTTCTGATTAAACGTCTGATGCATATCATTTTTCTATAA
GTAATCAGTTGCTTTTAAAATCAGAAGGCTATATTATTCTAATGACCCTATTCGATCTAAAT
GGGTTTGAGAATCCATATCAGCAACATACGTGTTTTTGACAGAAAGTGAAAACAAATTCCG
TAAAACTGTTAGTATCAAAAGAATAGGAATACAGTTTTCTTTTCCACATTATGATCAAATAAA
AATCTTGTGAGATTGTTAAAAA

FIGURE 4

```
></usr/seqdb2/sst/DNA/Dnaseqs.min/ss.DNA94849
><subunit 1 of 1, 515 aa, 1 stop
><MW: 59357, pI: 9.40, NX(S/T): 3
MVSIPEYYEGKNVLLTGATGFLGKVLLEKLLRSCPKVNSVYVLVRQKAGQTPQERVEEVL
SGKLFDRLRDENPDFREKIIAINSELTQPKLALSEEDKEVIIDSTNIIFHCAATVRFNEN
LRDAVQLNVIATRQLILLAQQMKNLEVFMHVSTAYAYCNRKHIDEVVYPPPVDPKKLIDS
LEWMDDGLVNDITPKLIGDRPNTYIYTKALAEYVVQQEGAKLNVAIVRPSIVGASWKEPF
PGWIDNFNGPSGLFIAAGKGILRTIRASNNALADLVPVDVVVNMSLAAAWYSGVNRPRNI
MVYNCTTGSTNPFHWGEVEYHVISTFKRNPLEQAFRRPNVNLTSNHLLYHYWIAVSHKAP
AFLYDIYLRMTGRSPRMMKTITRLHKAMVFLEYFTSNSWVWNTENVNMLMNQLNPEDKKT
FNIDVRQLHWAEYIENYCLGTKKYVLNEEMSGLPAARKHLNKLRNIRYGFNTILVILIWR
IFIARSQMARNIWYFVVSLCYKFLSYFRASSTMRY
```

Important features of the protein:
Transmembrane domain:
Amino acids          469-488

N-glycosylation sites:
Amino acids          283-287;304-308;341-345

Tyrosine kinase phosphorylation site:
Amino acids          160-169

N-myristoylation sites:
Amino acids          219-225;252-258;260-266;452-458

Leucine zipper pattern:
Amino acids          439-461

FIGURE 5

```
CGATGCCGGCGGTCAGTGGTCCAGGTCCCTTATTCTGCCTTCTCCTCCTGCTCCTGGACCCC
CACAGCCCTGAGACGGGGTGTCCTCCTCTACGCAGGTTTGAGTACAAGCTCAGCTTCAAAGG
CCCAAGGCTGGCATTGCCTGGGGCTGGAATACCCTTCTGGAGCCATCATGGAGACGCCATCC
TGGGCCTGGAGGAAGTGCGGCTGACGCCATCCATGAGGAACCGGAGTGGCGCCGTGTGGAGC
AGGGCCTCTGTCCCCTTCTCTGCCTGGGAAGTAGAGGTGCAGATGAGGGTGACGGGACTGGG
GCGCCGGGGAGCCCAGGGCATGGCCGTGTGGTACACCCGGGGCAGGGGCCATGTAGGCTCTG
TCCTTGGGGGGCTGGCTTCGTGGGACGGCATCGGGATCTTCTTTGACTCTCCGGCAGAGGAT
ACTCAGGACAGTCCTGCCATCCGTGTGCTGGCCAGCGACGGGCACATCCCCTCTGAGCAGCC
TGGGGATGGAGCTAGCCAAGGGCTGGGCTCCTGTCATTGGGACTTCCGGAACCGGCCACACT
CCTTCAGAGCACGGATCACCTACTGGGGCAGAGGCTGCGCATGTCCTTGAACAGTGGCCTC
ACTCCCAGTGATCCAGGTGAGTTCTGTGTGGATGTGGGGCCCCTGCTTTTGGTCCCTGGAGG
TTTCTTTGGGGTCTCAGCAGCCACCGGCACCCTGGCAGGTGAGGATCCCACTGGACAGGTTC
CCCCTCAGCCCTTCCTGGAGATGCAGCAGCTCCGCCTGGCGAGGCAGCTGGAAGGGCTGTGG
GCAAGGCTGGGCTTGGGCACCAGGGAGGATGTAACTCCAAAATCAGACTCTGAAGCTCAAGG
AGAAGGGGAAAGGCTCTTTGACCTGGAGGAGACGCTGGGCAGACACCGCCGGATCCTGCAGG
CTCTGCGGGGTCTCTCCAAGCAGCTGGCCCAGGCTGAGAGACAATGGAAGAAGCAGCTGGGG
CCCCCAGGCCAAGCCAGGCCTGACGGAGGCTGGGCCCTGGATGCTTCCTGCCAGATTCCATC
CACCCCAGGGAGGGGTGGCCACCTCTCCATGTCACTCAATAAGGACTCTGCCAAGGTCGGTG
CCCTGCTCCATGGACAGTGGACTCTGCTCCAGGCCCTGCAAGAGATGAGGGATGCAGCTGTC
CGCATGGCTGCAGAAGCCCAGGTCTCCTACCTGCCTGTGGGCATTGAGCATCATTTCTTAGA
GCTGGACCACATCCTGGGCCTCCTGCAGGAGGAGCTTCGGGGCCCGGCGAAGGCAGCAGCCA
AGGCCCCCCGCCCACCTGGCCAGCCCCAAGGGCCTCCTCGTGCCTGCAGCCTGGCATCTTC
CTGTTCTACCTCCTCATTCAGACTGTAGGCTTCTTCGGCTACGTGCACTTCAGGCAGGAGCT
GAACAAGAGCCTTCAGGAGTGTCTGTCCACAGGCAGCCTTCCTCTGGGTCCTGCACCACACA
CCCCCAGGGCCCTGGGGATTCTGAGGAGGCAGCCTCTCCCTGCCAGCATGCCTGCCTGACCC
ACCTCAGAGCCTGCTTTGCATCACTGGGAAGCAGGCAGTGTCTTGGGTGGGGCTTGGTCAG
TATCCTCTCCGTCTGGGTGCCCAGCTCCCACGCACACCTGAGCTTTCGGCATGCTCCCACCT
CGTTAAAGGTGATTTCCCTCTCCCCAAAAAAAAAAAAAAAAAAAAAAAAAAAAAAAAAAAAA
AAAAAAAAAAAAAAAAAAAAA
```

FIGURE 6

```
></usr/seqdb2/sst/DNA/Dnaseqs.min/ss.DNA96883
><subunit 1 of 1, 514 aa, 1 stop
><MW: 55687, pI: 8.78, NX(S/T): 2
MPAVSGPGPLFCLLLLLLDPHSPETGCPPLRRFEYKLSFKGPRLALPGAGIPFWSHHGDA
ILGLEEVRLTPSMRNRSGAVWSRASVPFSAWEVEVQMRVTGLGRRGAQGMAVWYTRGRGH
VGSVLGGLASWDGIGIFFDSPAEDTQDSPAIRVLASDGHIPSEQPGDGASQGLGSCHWDF
RNRPHSFRARITYWGQRLRMSLNSGLTPSDPGEFCVDVGPLLLVPGGFFGVSAATGTLAG
EDPTGQVPPQPFLEMQQLRLARQLEGLWARLGLGTREDVTPKSDSEAQGEGERLFDLEET
LGRHRRILQALRGLSKQLAQAERQWKKQLGPPGQARPDGGWALDASCQIPSTPGRGGHLS
MSLNKDSAKVGALLHGQWTLLQALQEMRDAAVRMAAEAQVSYLPVGIEHHFLELDHILGL
LQEELRGPAKAAAKAPRPPGQPPRASSCLQPGIFLFYLLIQTVGFFGYVHFRQELNKSLQ
ECLSTGSLPLGPAPHTPRALGILRRQPLPASMPA
```

Important features of the protein:
Signal peptide:
Amino acids     1-23

Transmembrane domain:
Amino acids     215-232;450-465

N-glycosylation sites:
Amino acids     75-79;476-480

Glycosaminoglycan attachment site:
Amino acids     5-9

N-myristoylation sites:
Amino acids     78-84;122-128;126-132;168-174;172-178;
                205-211;226-232;230-236;236-242;356-362

Amidation site:
Amino acids     102-106

FIGURE 7

```
GCCCCCAGCATGGCTTGGCAGGGCTGGCCCGCGGCGTGGCAGTGGGTCGCCGGCTGCTGGCT
CCTCCTCGTCCTTGTCCTCGTCCTACTTGTGAGCCCCGCGGCTGCCGAGCGCGGCGGGGCC
TCCGCGGTCTGCTCATGGCGCACAGCCAGCGGCTGCTCTTCCGAATCGGGTACAGCCTGTAC
ACCCGCACCTGGCTCGGGTACCTCTTCTACCGACAGCAGCTGCGCAGGGCTCGGAATCGCTAC
CCTAAAGGCCACTCGAAAACCCAGCCCCGCCTCTTCAATGGAGTGAAGGTGCTTCCCATCCC
TGTCCTCTCGGACAACTACAGCTACCTCATCATCGACACCCAGGCCCAGCTGGCTGTGGCTG
TGGACCCTTCAGACCCTCGGGCTGTGCAGGCTTCCATTGAAAAGGAAGGGGTCACCTTGGTC
GCCATTCTGTGTACTCACAAGCACTGGGACCACAGTGGAGGGAACCGTGACCTCAGCCGGCG
GCACCGGGACTGTCGGGTGTACGGGAGCCCTCAGGACGGCATCCCCTACCTCACCCATCCCC
TGTGTCATCAAGATGTGGTCAGCGTGGGACGGCTTCAGATCCGGGCCCTGGCTACACCTGGC
CACACACAAGGCCATCTGGTCTACCTACTGGATGGGGAGCCCTACAAGGGTCCCTCCTGCCT
CTTCTCAGGGGACCTGCTCTTCCTCTCTGGCTGTGGGCGGACCTTTGAGGGCAATGCAGAGA
CCATGCTGAGCTCACTGGACACTGTGCTGGGCTAGGGGATGACACCCTTCTGTGGCCTGGT
CATGAGTATGCAGAGGAGAACCTGGGCTTTGCAGGTGTGGTGGAGCCCGAGAACCTGGCCCG
GGAGAGGAAGATGCAGTGGGTGCAGCGGCAGCGGCTGGAGCGCAAGGGCACGTGCCCATCTA
CCCTGGGAGAGGAGCGCTCCTACAACCCGTTCCTGAGAACCCACTGCCTGGCGCTACAGGAG
GCTCTGGGGCCGGGCCGGGCCCCACTGGGGATGATGACTACTCCCGGGCCCAGCTCCTGGA
AGAGCTCCGCCGGCTGAAGGATATGCACAAGAGCAAGTGATGCCCCAGCGCCCCCAGCCCA
GCCCACTCCCCGCATGGGGAGGCCGCCACCACCAACACCTCATCATCCTTCTCATCGCTAAC
ACCACCACCTCCATCGGCACCCAAGCGGGCATCATCCCCCCACACTGCTCAGGGGAGGGGAG
GGATCAGGCGATGAGACTGTGAGGCCAAAAGAAGGGGGCCTGTTGGAGGCTGGGAACCCCGC
AGCGCGAGGCTGCCTCATCAACGGCAAGAGGAAAGGAGGGGTCTCGGGACATCTCCAGACCC
TACCAACTGGGAGGGTCCCCTCCTCCTTCCCTACTCCTGGGACGGCAGCAAGGACATGGGGG
CTGCTGTTAGCTTCTCCGTCAGGAGGCCTCATCTCACTGTAGCCCTGGAACCCAGGGTCCAT
CTTGCCCTTCCCCCATCCATGGTTGGGAAAGAAGCTCAGCCCCTCACAGTGGCCTCAAGTGT
GATGCCTTACAAAAGCACCACTCAGATGGGCAGCTGGACTCTGGTGTCCTGAGACTCTGCCC
TCTTCCCACAGCCTCCCTGCCCCACCCATCCCTGCAAAGCCATTTTTCAGACAGAGCCATTC
CTAAGAACACTGAAGGGCTGGAATGCTGGCTGGCCACTCTCTGCCTCAGTGGCCTCCCTACA
GCCTGGAAGAAGGAGGGTCCTGATTGCCAAGGAAACCTCCTCATTGGGCTAAGGAGACACTG
GAGTCTGGAGTGTGGAGCCCCACAGTCTTGCAGGTCACATGCTCTCCTTGCACATCTGGCCT
GGTTGTACCCACTGGCCTCTGCCTCTGCCCTGGGCCAAAAGGGCCCCTCCTTGCCAGGGGAG
AGACAGCCACGGTCCTCTTTGGCCGATGCTGTATTCTCATTTTGGCCCTTGTTCTTAGGCCC
GTCTGCCCGCCCTCCTCCATCTAACCTTTCCTGTTTTATCCGCAGCCCTTTTCTTCTTTGAG
TTAGTAAAGATTTATTCTGTAACCTGACACTCATCTGGCCCTTTGCAGTTTGCCAGCCATATTC
CCATGTGATTTCCCACTGGATCCAGGCCCCATCCGGCTGGCAGGAGGGGGCTCTGACGTAC
AGGTTGGAAATCAGAAGTCTGTGAGAGCGCGGGAGTGCATGGCAGCTCTGGGTCCCAGACCT
GGCCCGACCCCTCTGCTTCACCTCCAGCTCTGCTGCTCCTCTACTCTTGGGTCGAGATCCCT
TTGGAGCCACAGCGAGGAACCCTGTGGTCCTCAGGCAGGTGTACCTTGAGTCAGCCAGGAGC
CCTCTTTTCCTGTGTCAAAGCCTGCCCTCGGGCTCTGCTCACCTCTGGTGACCCTCCAAGAT
GCCCCTGCCCTCAGTTTCCCCTCATGATCTGGCCTCTGCCCCCTTCTCTAGCCACAGCCTCT
AGTACACTTTAGCAATACCACCAGACTAGTTAGAGTTCCCCACTCACCAAGCAAGACATGCA
GTTTCATGCCTCTGTGCCTTCGCTCATGCTGTTTCTTCCGACTGGAATGCCTTCCCCTGCTC
CTCCTGCCTTGTCTGCCTGGCAAGTTCATCTCTCACGATCCCCTCAAAGGCCCCCTCCTCCA
GGAAGGCAACCCCTGTGCCCCTCCCCTCCAGGCTACCTCTGCACTTTGTCAATGCTTCTCTT
GTGGCACTTATCACACTGTATTTTACTTGTTTACATGTTTGTCTCCCCTTCTAGACTGTGAA
TCCTTAAGGGCATGGACTGTATCTTATGCATCTCTGTATTTCTGCGCCTAGCACGGTGCCTA
GCACACAGTAGGCGCTCAATAAATGTTGAATGAATGAAAAAAAAAAAAAAAAAAAAAAAAAA
AAAAAAAAAAAAAAAAAAAAAAAAAAAAAAAAAAAAAAAAAAAAAAAAAAAAAAAAAAAAA
AAAAAAAAAAAAAAAAAAAAAAAAAAAAAA
```

FIGURE 8

```
></usr/seqdb2/sst/DNA/Dnaseqs.min/ss.DNA96894
><subunit 1 of 1, 361 aa, 1 stop
><MW: 40747, pI: 9.20, NX(S/T): 1
MAWQGWPAAWQWVAGCWLLLVLVLVLLVSPRGCRARRGLRGLLMAHSQRLLFRIGYSLYT
RTWLGYLFYRQQLRRARNRYPKGHSKTQPRLFNGVKVLPIPVLSDNYSYLIIDTQAQLAV
AVDPSDPRAVQASIEKEGVTLVAILCTHKHWDHSGGNRDLSRRHRDCRVYGSPQDGIPYL
THPLCHQDVVSVGRLQIRALATPGHTQGHLVYLLDGEPYKGPSCLFSGDLLFLSGCGRTF
EGNAETMLSSLDTVLGLGDDTLLWPGHEYAEENLGFAGVVEPENLARERKMQWVQRQRLE
RKGTCPSTLGEERSYNPFLRTHCLALQEALGPGPGPTGDDDYSRAQLLEELRRLKDMHKS
K
```

Important features of the protein:
Signal peptide:
Amino acids     1-35

N-glycosylation site:
Amino acids     106-110

Glycosaminoglycan attachment site:
Amino acids     234-238 cAMP- and cGMP-dependent protein kinase phosphorylation site:
Amino acids     301-305

Tyrosine kinase phosphorylation site:
Amino acids     162-171

N-myristoylation sites:
Amino acids     41-47;235-241;242-248;303-309

Prokaryotic membrane lipoprotein lipid attachment site:
Amino acids     6-17 cAMP phosphodiesterases class-II proteins:
Amino acids     144-161

FIGURE 9

GCTGACAATCCCCTTGACGTTCTATCCCGGAAGCTCCACCTGGGGCCCAATGTTGGGCGTGA
TGTTCCTCGCCTGTCTCTGCCTGGAAAACTGGTCTTCCCAAGCTCCACTGGCAGCCACTTCT
CCATGTTGGGCATCGGAGACATCGTTATGCCTGGTCTCCTACTATGCTTTGTCCTTCGCTAT
GACAACTACAAAAAGCAAGCCAGTGGGGACTCCTGTGGGGCCCCTGGACCTGCCAACATCTC
CGGGCGCATGCAGAAGGTCTCCTACTCTCACTGCACCCTCATCGGATACTTTGTAGGCCTGC
TCACTGCTACTGTGGCGTCTCGCATTCACCGGGCCGCCCAGCCCGCCCTTCTCTATTTGGTG
CCATTTACTTTATTGCCACTCCTCACGATGGCCTATTTAAAGGGCGACCTCCGGCGGATGTG
GTCTGAGCCTTTCCACTCCAAGTCCAGCAGCTCCCGATTCCTGGAAGTATGATGGATCACGT
GGAAAGTGACCAGATGGCCGTCATAGTCCTTTTCTCTCAACTCATGGTTTGTTTCCTCTTAG
AGCTGGCCTGGTACTCAGAAATGTACCTGTGTTTAAGGAACTGCCGTGTGACTGGATTTGGC
ATTGAAAGGGAGCTCGTTTGCAGGAGAGAGGTGCTGGAGCCCTGTTTGGTTCCTTCTCTTCC
TGCGGATGTAGAGGTGGGGCCCCTTCCAAGAGGGACAGGCCTCTCCCCAGCGCGCCTTCCTC
CCACGTTTTTATGGATCTGCACCAGACTGTTACCTTCTGGGGGAGATGGAGATTTGACTGTT
TAAAAACTGAAAACAGCGAGGAGTCTTTCTAGAACTTTTGAACACTAAAAGGATGAAAAAAT
TAGC

FIGURE 10

```
></usr/seqdb2/sst/DNA/Dnaseqs.min/ss.DNA100272
><subunit 1 of 1, 108 aa, 1 stop
><MW: 12055, pI: 4.69, NX(S/T): 0
MMDHVESDQMAVIVLFSQLMVCFLLELAWYSEMYLCLRNCRVTGFGIERELVCRREVLEP
CLVPSLPADVEVGPLPRGTGLSPARLPPTFLWICTRLLPSGGDGDLTV
```

Important features of the protein:
Signal peptide:
Amino acids     1-30

N-myristoylation site:
Amino acids     80-86

FIGURE 11

```
TCGCACACTGGTGGCTTCAGAAGAAATTCTCAACACCTAGCTCGCCAGAGAGTCTATGTATG
GGATTGAACAATCTGTAAACTAAAGGATCCTAATCATGAAAATAAGTATGATAAATTATAAG
TCACTATTGGCACTGTTGTTTATATTAGCCTCCTGGATCATTTTTACAGTTTTCCAGAACTC
CACAAAGGTTTGGTCTGCTCTAAACTTATCCATCTCCCTCCATTACTGGAACAACTCCACAA
AGTCCTTATTCCCTAAAACACCACTGATATCATTAAAGCCACTAACAGAGACTGAACTCAGA
ATAAAGGAAATCATAGAGAAACTAGATCAGCAGATCCCACCCAGACCTTTCACCCACGTGAA
CACCACCACCAGCGCCACACATAGCACAGCCACCATCCTCAACCCTCGAGATACGTACTGCA
GGGGAGACCAGCTGCACATCCTGCTGGAGGTGAGGGACCACTTGGGACGCAGGAAGCAATAT
GGCGGGGATTTCCTGAGGGCCAGGATGTCTTCCCCAGCGCTGATGGCAGGTGCTTCAGGAAA
GGTGACTGACTTCAACAACGGCACCTACCTGGTCAGCTTCACTCTGTTCTGGGAGGGCCAGG
TCTCTCTGTCTCTGCTGCTCATCCACCCCAGTGAAGGGGTGTCAGCTCTCTGGAGTGCAAGG
AACCAAGGCTATGACAGGGTGATCTTCACTGGCCAGTTTGTCAATGGCACTTCCCAAGTCCA
CTCTGAATGTGGCCTGATCCTAAACACAAATGCTGAATTGTGCCAGTACCTGGACAACAGAG
ACCAAGAAGGCTTCTACTGTGTGAGGCCTCAACACATGCCCTGTGCTGCACTCACTCACATG
TATTCTAAGAACAAGAAAGTTTCTTATCTTAGCAAACAAGAAAAGAGCCTCTTTGAAAGGTC
AAATGTGGGTGTAGAGATTATGGAAAAATTCAATACAATTAGTGTCTCCAAATGCAACAAAG
AAACAGTTGCAATGAAAGAGAAATGCAAGTTTGGAATGACATCCACAATCCCCAGTGGGCAT
GTCTGGAGAAACACATGGAATCCTGTCTCCTGTAGTTTGGCTACAGTCAAAATGAAGGAATGC
CTGAGAGGAAAACTCATATACCTAATGGGAGATTCCACGATCCGCCAGTGGATGGAATACTT
CAAAGCCAGTATCAACACACTGAAGTCAGTGGATCTGCATGAATCTGGAAAATTGCAACACC
AGCTTGCTGTGGATTTGGATAGGAACATCAACATCCAGTGGCAAAAATATTGTTATCCCTTG
ATAGGATCAATGACCTATTCAGTCAAAGAGATGGAGTACCTCACCCGGGCCATTGACAGAAC
TGGAGGAGAAAAAAATACTGTCATTGTTATTTCCCTGGGCCAGCATTTCAGACCCTTTCCCA
TTGATGTTTTATCCGAAGGGCCCTCAATGTCCACAAAGCCATTCAGCATCTTCTTCTGAGA
AGCCCAGACACTATGGTTATCATCAAAACAGAAAACATCAGGGAGATGTACAATGATGCAGA
AAGATTTAGTGACTTTCATGGTTACATTCAATATCTCATCATAAAGGACATTTTCCAGGATC
TCAGTGTGAGTATCATTGATGCCTGGGATATAACAATTGCATATGGCACAAATAATGTACAC
CCACCTCAACATGTAGTCGGAAATCAGATTAATATATTATTAAACTATATTTGTTAAATAACAA
```

FIGURE 12

```
></usr/seqdb2/sst/DNA/Dnaseqs.min/ss.DNA108696
><subunit 1 of 1, 544 aa, 1 stop
><MW: 62263, pI: 9.17, NX(S/T): 7
MKISMINYKSLLALLFILASWIIFTVFQNSTKVWSALNLSISLHYWNNSTKSLFPKTPLI
SLKPLTETELRIKEIIEKLDQQIPPRPFTHVNTTTSATHSTATILNPRDTYCRGDQLHIL
LEVRDHLGRRKQYGGDFLRARMSSPALMAGASGKVTDFNNGTYLVSFTLFWEGQVSLSLL
LIHPSEGVSALWSARNQGYDRVIFTGQFVNGTSQVHSECGLILNTNAELCQYLDNRDQEG
FYCVRPQHMPCAALTHMYSKNKKVSYLSKQEKSLFERSNVGVEIMEKFNTISVSKCNKET
VAMKEKCKFGMTSTIPSGHVWRNTWNPVSCSLATVKMKECLRGKLIYLMGDSTIRQWMEY
FKASINTLKSVDLHESGKLQHQLAVDLDRNINIQWQKYCYPLIGSMTYSVKEMEYLTRAI
DRTGGEKNTVIVISLGQHFRPFPIDVFIRRALNVHKAIQHLLLRSPDTMVIIKTENIREM
YNDAERFSDFHGYIQYLIIKDIFQDLSVSIIDAWDITIAYGTNNVHPPQHVVGNQINILL
NYIC
```

Important features of the protein:
Signal peptide:
Amino acids     1-22

N-glycosylation sites:
Amino acids     29-33;38-42;47-51;48-52;92-96;160-164;210-214 cAMP- and cGMP-dependent protein kinase phosphorylation site:
Amino acids     262-266

Tyrosine kinase phosphorylation site:
Amino acids     236-243;486-494

N-myristoylation sites:
Amino acids     206-212;220-226;310-316;424-430;533-539

Amidation site:
Amino acids     127-131

Cell attachment sequence:
Amino acids     113-116

FIGURE 13

```
GCAAAGAGAAGACTGAAAGACAAACCTGGGTGCAGCCAGAGAGGTCCAGATAGATGAGCTTG
TGGCATCCATTCCCCAAGTTCAGCCTAGGGACTCCACGTACCCCAGCTGGGTCTCATTGTTC
CAGAACTGCATTAGTTAAGATTACCCAGACTTGGATTTCAAAGGAATACTTTCATTGTTCCG
TCTGTAACACGAAGTAATTGGGGCCAGCTGGATGTCAGGATGCGTGTGGTTACCATTGTAAT
CTTGCTCTGCTTTTGCAAAGCGGCTGAGCTGCGCAAAGCAAGCCCAGGCAGTGTGAGAAGCC
GAGTGAATCATGGCCGGGCGGTGGAGGCCGGAGAGGCTCCAACCCGGTCAAACGCTACGCA
CCAGGCCTCCCGTGTGACGTGTACACATATCTCCATGAGAAATACTTAGATTGTCAAGAAAG
AAAATTAGTTTATGTGCTGCCTGGTTGGCCTCAGGATTTGCTGCACATGCTGCTAGCAAGAA
ACAAGATCCGCACATTGAAGAACAACATGTTTTCCAAGTTTAAAAAGCTGAAAAGCCTGGAT
CTGCAGCAGAATGAGATCTCTAAAATTGAGAGTGAGGCGTTCTTTGGTTTAAACAAACTCAC
CACCCTCTTACTGCAGCACAACCAGATCAAAGTCTTGACGGAGGAAGTGTTCATTTACACAC
CTCTCTTGAGCTACCTGCGTCTTTATGACAACCCCTGGCACTGTACTTGTGAGATAGAAACG
CTTATTTCAATGTTGCAGATTCCCAGGAACCGGAATTTGGGGAACTACGCCAAGTGTGAAAG
TCCACAAGAACAAAAAAATAAAAAACTGCGGCAGATAAAATCTGAACAGTTGTGTAATGAAG
AAAAGGAACAATTGGACCCGAAACCCCAAGTGTCAGGGAGACCCCCAGTCATCAAGCCTGAG
GTGGACTCAACTTTTTGCCACAATTATGTGTTTCCCATACAAACACTGGACTGCAAAAGGAA
AGAGTTGAAAAAAGTGCCAAACAACATCCCTCCAGATATTGTTAAACTTGACTTGTCATACA
ATAAAATCAACCAACTTCGACCCAAGGAATTTGAAGATGTTCATGAGCTGAAGAAATTAAAC
CTCAGCAGCAATGGCATTGAATTCATCGATCCTGCCGCTTTTTTAGGGCTCACACATTTAGA
AGAATTAGATTTATCAAACAACAGTCTGCAAAACTTTGACTATGGCGTATTAGAAGACTTGT
ATTTTTTGAAACTCTTGTGGCTCAGAGATAACCCTTGGAGATGTGACTACAACATTCACTAC
CTCTACTACTGGTTAAAGCACCACTACAATGTCCATTTTAATGGCCTGGAATGCAAAACGCCT
GAAGAATACAAAGGATGGTCTGTGGGAAAATATATTAGAAGTTACTATGAAGAATGCCCCAA
AGACAAGTTACCAGCATATCCTGAGTCATTTGACCAAGACACAGAAGATGATGAATGGGAAA
AAAAACATAGAGATCACACCGCAAAGAAGCAAAGCGTAATAATTACTATAGTAGGATAAGGT
AGAAATTGTTCTGATTGTAATTAGTTTTGTATTTTCTATACTGGTGTTAGAAAACATATGTT
TACATTTGATTAACTGTGTTGCCTATTTATGCAGGGTAATCCAGCTAAAGGAAGCTTTCTTT
AATTATAAGTATTATTGTGACTATTATAGTAATCAAGAGAATGCTATCATCCTGCTTGCCTG
TCCATTTGTGGAACAGCATCTGGTGATATGCAATTCCACACTGGTAACCTGCAGCAGTTGGG
TCCTAATGATGGCATTAGACTTTCATAATGTCCTGTATAAATGTTTTTACTGCTTTTAGAAA
ATAAAGAAAAAAACTTGGTTCATGTTTAAAA
```

FIGURE 14

```
></usr/seqdb2/sst/DNA/Dnaseqs.min/ss.DNA117935
><subunit 1 of 1, 440 aa, 1 stop
><MW: 51670, pI: 8.70, NX(S/T): 2
MRVVTIVILLCFCKAAELRKASPGSVRSRVNHGRAGGGRRGSNPVKRYAPGLPCDVYTYL
HEKYLDCQERKLVYVLPGWPQDLLHMLLARNKIRTLKNNMFSKFKKLKSLDLQQNEISKI
ESEAFFGLNKLTTLLLQHNQIKVLTEEVFIYTPLLSYLRLYDNPWHCTCEIETLISMLQI
PRNRNLGNYAKCESPQEQKNKKLRQIKSEQLCNEEKEQLDPKPQVSGRPPVIKPEVDSTF
CHNYVFPIQTLDCKRKELKKVPNNIPPDIVKLDLSYNKINQLRPKEFEDVHELKKLNLSS
NGIEFIDPAAFLGLTHLEELDLSNNSLQNFDYGVLEDLYFLKLLWLRDNPWRCDYNIHYL
YYWLKHHYNVHFNGLECKTPEEYKGWSVGKYIRSYYEECPKDKLPAYPESFDQDTEDDEW
EKKHRDHTAKKQSVIITIVG
```

Important features of the protein:
Signal peptide:
Amino acids      1-15

N-glycosylation sites:
Amino acids      297-301;324-328 cAMP- and cGMP-dependent protein kinase phosphorylation sites:
Amino acids      19-23;39-43;430-434

N-myristoylation sites:
Amino acids      24-30;37-43

Amidation site:
Amino acids      37-41

FIGURE 15

GCGGCAGCAGCGCGGGCCCCAGCAGCCTCGGCAGCCACAGCCGCTGCAGCCGGGGCAGCCTC
CGCTGCTGTCGCCTCCTCTGATGCGCTTGCCCTCTCCCGGCCCCGGGACTCCGGGAGAATGT
GGGTCCTAGGCATCGCGGCAACTTTTTGCGGATTGTTCTTGCTTCCAGGCTTTGCGCTGCAA
ATCCAGTGCTACCAGTGTGAAGAATTCCAGCTGAACAACGACTGCTCCTCCCCCGAGTTCAT
TGTGAATTGCACGGTGAACGTTCAAGACATGTGTCAGAAAGAAGTGATGGAGCAAAGTGCCG
GGATCATGTACCGCAAGTCCTGTGCATCATCAGCGGCCTGTCTCATCGCCTCTGCCGGGTAC
CAGTCCTTCTGCTCCCAGGGAAACTGAACTCAGTTTGCATCAGCTGCTGCAACACCCCTCT
TTGTAACGGGCCAAGGCCCAAGAAAAGGGGAAGTTCTGCCTCGGCCCTCAGGCCAGGGCTCC
GCACCACCATCCTGTTCCTCAAATTAGCCCTCTTCTCGGCACACTGCTGAAGCTGAAGGAGA
TGCCACCCCTCCTGCATTGTTCTTCCAGCCCTCGCCCCAACCCCCCACCTCCCTGAGTGA
GTTTCTTCTGGGTGTCCTTTTATTCTGGGTAGGGAGCGGGAGTCCGTGTTCTCTTTTGTTCC
TGTGCAAATAATGAAAGAGCTCGGTAAAGCATTCTGAATAAATTCAGCCTGACTGAATTTTC
AGTATGTACTTGAAGGAAGGAGGTGGAGTGAAAGTTCACCCCCATGTCTGTGTAACCGGAGT
CAAGGCCAGGCTGGCAGAGTCAGTCCTTAGAAGTCACTGAGGTGGGCATCTGCCTTTTGTAA
AGCCTCCAGTGTCCATTCCATCCCTGATGGGGGCATAGTTTGAGACTGCAGAGTGAGAGTGA
CGTTTTCTTAGGGCTGGAGGGCCAGTTCCCACTCAAGGCTCCCTCGCTTGACATTCAAACTT
CATGCTCCTGAAAACCATTCTCTGCAGCAGAATTGGCTGGTTTCGCGCCTGAGTTGGGCTCT
AGTGACTCGAGACTCAATGACTGGGACTTAGACTGGGGCTCGGCCTCGCTCTGAAAAGTGCT
TAAGAAAATCTTCTCAGTTCTCCTTGCAGAGGACTGGCGCCGGGACGCGAAGAGCAACGGGC
GCTGCACAAAGCGGGCGCTGTCGGTGGTGGAGTGCGCATGTACGCGCAGGCGCTTCTCGTGG
TTGGCGTGCTGCAGCGACAGGCGGCAGCACAGCACCTGCACGAACACCCGCCGAAACTGCTG
CGAGGACACCGTGTACAGGAGCGGGTTGATGACCGAGCTGAGGTAGAAAAACGTCTCCGAGA
AGGGGAGGAGGATCATGTACGCCCGGAAGTAGGACCTCGTCCAGTCGTGCTTGGGTTTGGCC
GCAGCCATGATCCTCCGAATCTGGTTGGGCATCCAGCATACGGCCAATGTCACAACAATCAG
CCCTGGGCAGACACGAGCAGGAGGGAGAGACAGAGA

FIGURE 16

```
></usr/seqdb2/sst/DNA/Dnaseqs.min/ss.DNA119474
><subunit 1 of 2, 141 aa, 1 stop
><MW: 15240, pI: 8.47, NX(S/T): 1
MWVLGIAATFCGLFLLPGFALQIQCYQCEEFQLNNDCSSPEFIVNCTVNVQDMCQKEVME
QSAGIMYRKSCASSAACLIASAGYQSFCSPGKLNSVCISCCNTPLCNGPRPKKRGSSASA
LRPGLRTTILFLKLALFSAHC
```

Important features of the protein:
Signal peptide:
Amino acids    1-22

N-glycosylation site:
Amino acids    45-49 cAMP- and cGMP-dependent protein kinase phosphorylation site:
Amino acids    113-117

N-myristoylation sites:
Amino acids    5-11;115-121;124-130

Ly-6 / u-PAR domain proteins:
Amino acids    94-107

FIGURE 17

CGCAAAGCCGCCCTCGGGGCGCTCATGGCGGGACGCCTCCTGGGAAAGGCTTTAGCCGCGGT
GTCTCTCTCTCTGGCCTTGGCCTCTGTGACTATCAGGTCCTCGCGCTGCCGCGGCATCCAGG
CGTTCAGAAACTCGTTTTCATCTTCTTGGTTTCATCTTAATACCAACGTCATGTCTGGTTCT
AATGGTTCCAAAGAAAATTCTCACAATAAGGCTCGGACGTCTCCTTACCCAGGTTCAAAAGT
TGAACGAAGCCAGGTTCCTAATGAGAAAGTGGGCTGGCTTGTTGAGTGGCAAGACTATAAGC
CTGTGGAATACACTGCAGTCTCTGTCTTGGCTGGACCCAGGTGGGCAGATCCTCAGATCAGT
GAAAGTAATTTTTCTCCCAAGTTTAACGAAAAGGATGGGCATGTTGAGAGAAAGAGCAAGAA
TGGCCTGTATGAGATTGAAAATGGAAGACCGAGAAATCCTGCAGGACGGACTGGACTGGTGG
GCCGGGGGCTTTTGGGGCGATGGGGCCCAAATCACGCTGCAGATCCCATTATAACCAGATGG
AAAAGGGATAGCAGTGGAAATAAAATCATGCATCCTGTTTCTGGGAAGCATATCTTACAATT
TGTTGCAATAAAAAGGAAAGACTGTGGAGAATGGGCAATCCCAGGGGGGATGGTGGATCCAGGA
GAGAAGATTAGTGCCACACTGAAAAGAGAATTTGGTGAGGAAGCTCTCAACTCCTTACAGAA
AACCAGTGCTGAGAAGAGAGAAATAGAGGAAAAGTTGCACAAACTCTTCAGCCAAGACCACC
TAGTGATATATAAGGGATATGTTGATGATCCTCGAAACACTGATAATGCATGGATGGAGACA
GAAGCTGTGAACTACCATGACGAAACAGGTGAGATAATGGATAATCTTATGCTAGAAGCTGG
AGATGATGCTGGAAAAGTGAAATGGGTGGACATCAATGATAAACTGAAGCTTTATGCCAGTC
ACTCTCAATTCATCAAACTTGTGGCTGAGAAACGAGATGCACACTGGAGCGAGGACTCTGAA
GCTGACTGCCATGCGTTGTAGCTGATGGTCTCCGTGTAAGCCAAAGGCCCACAGAGGAGCAT
ATACTGAAAAGAAGGCAGTATCACAGAATTTATACTATAAAAAGGGCAGGGTAGGCCACTTG
GCCTATTTACTTTCAAAACAATTTGCATTTAGAGTGTTTCGCATCAGAATAACATGAGTAAG
ATGAACTGGAACACAAAATTTTCAGCTCTTTGGTCAAAAGGAATATAAGTAATCATATTTTG
TATGTATTCGATTTAAGCATGGCTTAAATTAAATTTAAACAACTAATGCTCTTTGAAGAATC
ATAATCAGAATAAAGATAAATTCTTGATCAGCTATA

FIGURE 18

```
></usr/seqdb2/sst/DNA/Dnaseqs.min/ss.DNA119498
><subunit 1 of 1, 350 aa, 1 stop
><MW: 39125, pI: 8.53, NX(S/T): 2
MAGRLLGKALAAVSLSLALASVTIRSSRCRGIQAFRNSFSSSWFHLNTNVMSGSNGSKEN
SHNKARTSPYPGSKVERSQVPNEKVGWLVEWQDYKPVEYTAVSVLAGPRWADPQISESNF
SPKFNEKDGHVERKSKNGLYEIENGRPRNPAGRTGLVGRGLLGRWGPNHAADPIITRWKR
DSSGNKIMHPVSGKHILQFVAIKRKDCGEWAIPGGMVDPGEKISATLKREFGEEALNSLQ
KTSAEKREIEEKLHKLFSQDHLVIYKGYVDDPRNTDNAWMETEAVNYHDETGEIMDNLML
EAGDDAGKVKWVDINDKLKLYASHSQFIKLVAEKRDAHWSEDSEADCHAL
```

Important features of the protein:
Signal peptide:
Amino acids    1-20

N-glycosylation site:
Amino acids    55-59 cAMP- and cGMP-dependent protein kinase phosphorylation site:
Amino acids    179-183

N-myristoylation sites:
Amino acids    53-59; 56-62 mutT domain signature:
Amino acids    215-235

FIGURE 19

CGAGGGCTCCTGCTGGTACTGTGTTCGCTGCTGCACAGCAAGGCCCTGCCACCCACCTTCAG
GCCATGCAGCCATGTTCCGGGAGCCCTAATTGCACAGAAGCCCATGGGGAGCTCCAGACTGG
CAGCCCTGCTCCTGCCTCTCCTCCTCATAGTCATCGACCTCTCTGACTCTGCTGGGATTGGC
TTTCGCCACCTGCCCCACTGGAACACCCGCTGTCCTCTGGCCTCCCACACGGATGACAGTTT
CACTGGAAGTTCTGCCTATATCCCTTGCCGCACCTGGTGGGCCCTCTTCTCCACAAAGCCTT
GGTGTGTGCGAGTCTGGCACTGTTCCCGCTGTTTGTGCCAGCATCTGCTGTCAGGTGGCTCA
GGTCTTCAACGGGGCCTCTTCCACCTCCTGGTGCAGAAATCCAAAAAGTCTTCCACATTCAA
GTTCTATAGGAGACACAAGATGCCAGCACCTGCTCAGAGGAAGCTGCTGCCTCGTCGTCACC
TGTCTGAGAAGAGCCATCACATTTCCATCCCCTCCCCAGACATCTCCCACAAGGGACTTCGC
TCTAAAAGGACCCAACCTTCGGATCCAGAGACATGGGAAAGTCTTCCCAGATTGGACTCACA
AAGGCATGGAGGACCCGAGTTCTCCTTTGATTTGCTGCCTGAGGCCCGGGCTATTCGGGTGA
CCATATCTTCAGGCCCTGAGGTCAGCGTGCGTCTTTGTCACCAGTGGGCACTGGAGTGTGAA
GAGCTGAGCAGTCCCTATGATGTCCAGAAAATTGTGTCTGGGGGCCACACTGTAGAGCTGCC
TTATGAATTCCTTCTGCCCTGTCTGTGCATAGAGGCATCCTACCTGCAAGAGGACACTGTGA
GGCGCAAAAAATGTCCCTTCCAGAGCTGGCCAGAAGCCTATGGCTCGGACTTCTGGAAGTCA
GTGCACTTCACTGACTACAGCCAGCACACTCAGATGGTCATGGCCCTGACACTCCGCTGCCC
ACTGAAGCTGGAAGCTGCCCTCTGCCAGAGGCACGACTGGCATACCCTTTGCAAAGACCTCC
CGAATGCCACGGCTCGAGAGTCAGATGGGTGGTATGTTTTGGAGAAGGTGGACCTGCACCCC
CAGCTCTGCTTCAAGTTCTCTTTTGGAAACAGCAGCCATGTTGAATGCCCCCACCAGACTGG
GTCTCTCACATCCTGGAATGTAAGCATGGATACCCAAGCCCAGCAGCTGATTCTTCACTTCT
CCTCAAGAATGCATGCCACCTTCAGTGCTGCCTGGAGCCTCCCAGGCTTGGGGCAGGACACT
TTGGTGCCCCCCGTGTACACTGTCAGCCAGGCCCGGGGCTCAAGCCCAGTGTCACTAGACCT
CATCATTCCCTTCCTGAGGCCAGGGTGCTGTGTCCTGGTGTGGCGGTCAGATGTCCAGTTTG
CCTGGAAGCACCTCTTGTGTCCAGATGTCTCTTACAGACACCTGGGGCTCTTGATCCTGGCA
CTGCTGGCCCTCCTCACCCTACTGGGTGTTGTTCTGGCCCTCACCTGCCGGCGCCCACAGTC
AGGCCCGGGCCCAGCGCGGCCAGTGCTCCTCCTGCACGCGGCGGACTCGGAGGCGCAGCGGC
GCCTGGTGGGAGCGCTGGCTGAACTGCTACGGGCAGCGCTGGGCGGCGGGCGCGACGTGATC
GTGGACCTGTGGGAGGGGAGGCACGTGGCGCGCGTGGGCCCGCTGCCGTGGCTCTGGGCGGC
GCGGACGCGCGTAGCGCGGGAGCAGGGCACTGTGCTGCTGCTGTGGAGCGGCGCCGACCTTC
GCCCGGTCAGCGGCCCCGACCCCGCGCCGCGCCCTGCTCGCCCTGCTCCACGCTGCCCCG
CGCCCGCTGCTGCTGCTCGCTTACTTCAGTCGCCTCTGCGCCAAGGGCGACATCCCCCCGCC
GCTGCGCGCCCTGCCGCGCTACCGCCTGCTGCGCGACCTGCCGCGTCTGCTGCGGGCGCTGG
ACGCGCGGCCTTTCGCAGAGGCCACCAGCTGGGCCGCCTTGGGGCGCGGCAGCGCAGGCAG
AGCCGCCTAGAGCTGTGCAGCCGGCTTGAACGAGAGGCCGCCCGACTTGCAGACCTAGGTTG
AGCAGAGCTCCACCGCAGTCCCGGGTGTCT

FIGURE 20

```
></usr/seqdb2/sst/DNA/Dnaseqs.min/ss.DNA119502
><subunit 1 of 1, 667 aa, 1 stop
><MW: 74810, pI: 9.55, NX(S/T): 3
MGSSRLAALLLPLLLIVIDLSDSAGIGFRHLPHWNTRCPLASHTDDSFTGSSAYIPCRTW
WALFSTKPWCVRVWHCSRCLCQHLLSGGSGLQRGLFHLLVQKSKKSSTFKFYRRHKMPAP
AQRKLLPRRHLSEKSHHISIPSPDISHKGLRSKRTQPSDPETWESLPRLDSQRHGGPEFS
FDLLPEARAIRVTISSGPEVSVRLCHQWALECEELSSPYDVQKIVSGGHTVELPYEFLLP
CLCIEASYLQEDTVRRKKCPFQSWPEAYGSDFWKSVHFTDYSQHTQMVMALTLRCPLKLE
AALCQRHDWHTLCKDLPNATARESDGWYVLEKVDLHPQLCFKFSFGNSSHVECPHQTGSL
TSWNVSMDTQAQQLILHFSSRMHATFSAAWSLPGLGQDTLVPPVYTVSQARGSSPVSLDL
IIPFLRPGCCVLVWRSDVQFAWKHLLCPDVSYRHLGLLILALLALLTLLGVVLALTCRRP
QSGPGPARPVLLLHAADSEAQRRLVGALAELLRAALGGGRDVIVDLWEGRHVARVGPLPW
LWAARTRVAREQGTVLLLWSGADLRPVSGPDPRAAPLLALLHAAPRPLLLLAYFSRLCAK
GDIPPPLRALPRYRLLRDLPRLLRALDARPFAEATSWGRLGARQRRQSRLELCSRLEREA
ARLADLG Important features of the protein:
    Signal peptide:
    Amino acids    1-23

Transmembrane domain:
    Amino acids    455-472

N-glycosylation sites:
    Amino acids    318-322;347-351;364-368

Glycosaminoglycan attachment site:
    Amino acids    482-486 cAMP- and cGMP-dependent protein kinase phosphorylation sites:
    Amino acids    104-108;645-649

Tyrosine kinase phosphorylation site:
    Amino acids    322-329

N-myristoylation sites:
    Amino acids    90-96;358-364;470-476

Eukaryotic cobalamin-binding proteins:
    Amino acids    453-462
```

FIGURE 21

```
CGGCTCGAGGCCCTTTGTGAGGGCTGTGAGCTGCGCCTGACGGTGGCACCATGAGCAGCTCA
GGTGGGGCGCCCGGGGCGTCCGCCAGCTCTGCGCCGCCCGCGCAGGAAGAGGGCATGACGTG
GTGGTACCGCTGGCTGTGTCGCCTGTCTGGGGTGCTGGGGGCAGTCTCTTGCGCGATCTCTG
GCCTCTTCAACTGCATCACCATCCACCCTCTGAACATCGCGGCCGGCGTGTGGATGATCATG
AATGCCTTCATCTTGTTGCTGTGTGAGGCGCCCTTCTGCTGCCAGTTCATCGAGTTTGCAAA
CACAGTGGCGGAGAAGGTGGACCGGCTGCGCTCCTGGCAGAAGGCTGTCTTCTACTGCGGGA
TGGCGGTCGTTCCCATCGTCATCAGCCTGACCCTGACCACGCTGCTGGGCAACGCCATCGCC
TTTGCTACGGGGGTGCTGTACGGACTCTCTGCTCTGGGCAAAAAGGGCGATGCGATCTCCTA
TGCCAGGATCCAGCAGCAGAGGCAGCAGGCGGATGAGGAGAAGCTCGCGGAGACCCTGGAGG
GGGAGCTGTGAAGGGCTGGGCGCCCCTCCCTCCCTGTCCCCTCTTCTGGCTCTGTGTGGGTC
CAAGTGAGGCCTGGACTGTCCACGCTGAGGCACAGCCTGGAGAGGGGCCTTTGCACGTGTCC
CTACACCTGGAGTCCTCTGCTCCTTTCTCCAGACTGGCTTAAGCCAGGAGCCACTGGCTGCT
GGTGTGAGGGTCTGGGCTGCTGGACTTGAGGCAGAGCCTGCAGCAGCTGTGTGGACACTACC
CAGCCCTACTCCTCTGCTGGGTGGGTCTGCAGATCTCACACCACAGACAGGGCTGCCTGTGA
CCTGCTGTGACCTGGGAGCAGCTTCCCCTGGAGATGCTGGTCCTGGCTTGAGGGGAGGGGCA
AGTGGGACCCTGCCACCTGGGCACTGAGCAGAGGGACCTCCCCCAGCTCTCTTAGCAGGTGG
AGCCCCAGGGCCTGGACAGCCTGCCGCTGCCAGCAACCTCCCACTGCTGCCTAGGGTGCAG
CGCCCACTGTCACCCTGCCTTCTGAAGAAGCCCACAGGGCTCCTAAGGTGCACCCCGGTACC
TGGAACTGCAGCCTTGGCAGTGACTGGACAGCTGGGTGGGGATGCTCCCTGCTGGCCCTGG
GAACCTTGGACAGGCCACCTCAAGGCCCCTCGGCTGCCCCTCCTCCCTGGGCCTGCTGGGC
CCCTAGGTTCTACCCATCACCCCCCGCCCTGCTGGCCTTGGTGCTAAGGAAGTGGGGAGAG
CAGGCTCTCCCTGGCACCGAGGGTGCCCACCCTCTCCCTGGTGTGGCCCCGTCAACATCAGC
CACAGCCCAGCCCCATTAGTGGGTTAGTGGGTCTGACCTCAGCCCCACTCAGGTGCTCCTGC
TGGCCTGCCCAAGCCCTGCCCTCAGGGAGCTTCTGCCTTTTAAGAACTGGGCAGAGGCCACAGT
CACCTCCCCACACAGAGCTGTCCCCACTGCCCTGGGTGCCAGGCTGTCCGGAGCCAGGCCTA
CCCAGGGAGGATGCAGAGAGCTGGTGCCCAGGATGTGCACCCCCATATTCCCTCTGCCCTGT
GGCCTCAGCCCGCTGGCCTCTCTGACCGTGAGGCTGGCTCTCAGCCATCGGGCAGGTGCCTG
GTCAGGCCTGGCTTAGCCCAGGTGGGGCTTGGCAGAAGCGGGCGGGTGTGGAAGATATTCCA
TCTGGGGCCAACCCCAGGCTGGGCCTGCGCTGAGCTTCTGGAGCGCAGGTACTGGGTCTTGC
TAAGTGAACTGTTTCCCAGGAACACCTCTCGGGCCCATCTGCGTCTGAGGCTGGGAGTGGCA
TCTGAGGCCGGGAGTGGCATCTGAGGCCAGGAGTGGCAGGCTGGTGGGCTGGGCGTGGGGTT
TTCTGGGCCCTGCCCAGTACTGCCCTGGGGACTTGGTGGGCTCCTGGGTCAGCAGCATCCCA
CCCCTGGGAGTCTGGCCAGCTGAGCCCCAGGGTGGCAGGGGCATTATAGCCTGGTGGACATG
TGCCTTCAGGGTTCCTCCGGGGCCACCTTCCTCAGGCCAGTGCTGGGTTCAAAGGGCTGTGT
GTGTGTGTGTTTGTGTGTATGTATATGTGTGTGGGTGCACACATCTGTCCCATGTATGCA
GTGAGACCTGTCTACCTCCCACAAGGAGCAAGGGCTCTGCCCGCCCTCTGCTCATTCCTACC
CAGGTAGTGGGACCCCGGGCCCCTTCTGCCTGGCTTGCCTGCTTCTGCCCTTTCCAGAGGG
GTCTCACTGACAGCCAGAGACAGCAGGAGAAGGGTTGGCTGTGGATCAAGGAAGGCTGCCCC
TGTACCCTGTGGGGAAATGGTGGGTGCATGGCTGGATGCAGAGGTGGAAGGCCCTGGGCCAC
AGGCGAGAGTGGGCGTGTCACCTGTCCCAGGTTCCCAGCAAGTCTGCAGCTGTGCAGTCCTG
GGGTCCCTGACCCTGTCGCCCAGGGGCGTGCTGTCCAGCAGGGGCCCTGCCTTGCAAGGAA
CGTCTCTCCGGCGGCTGGGCCGCTCCTGCCTGGTCTGGGCTGTGTGTGGCGCCCTTTCCTCC
TTGTTTGTTCCTCTGTGTTCTGTGTGCGTCTTAAGCAATAAAGCGTGGCCGTGGGAAAAAAA
AAAAAAAAAAAAAAAAAAAAAAAAAAAAAAAAAAAAAAAAAAA
```

FIGURE 22

```
></usr/seqdb2/sst/DNA/Dnaseqs.min/ss.DNA119516
><subunit 1 of 1, 172 aa, 1 stop
><MW: 18470, pI: 5.45, NX(S/T): 0
MSSSGGAPGASASSAPPAQEEGMTWWYRWLCRLSGVLGAVSCAISGLFNCITIHPLNIAA
GVWMIMNAFILLLCEAPFCCQFIEFANTVAEKVDRLRSWQKAVFYCGMAVVPIVISLTLT
TLLGNAIAFATGVLYGLSALGKKGDAISYARIQQQRQQADEEKLAETLEGEL
```

Important features of the protein:
Signal peptide:
Amino acids    1-42

Transmembrane domains:
Amino acids    64-77;109-128

Tyrosine kinase phosphorylation site:
Amino acids    142-150

N-myristoylation sites:
Amino acids    5-11;6-12;9-15;35-41;38-44;46-52;124-130;132-138

Amidation site:
Amino acids    140-144

FIGURE 23

```
GTGAAACACCCATGGTTTTATGCTCTATTTCTCTTTTCCTCATCTTCTTCCACATCCTCTTT
CTGAATGTATCAAACTACTTCCTTGAAGTGGGGCACCAGGAGGGCCACTCCAGTCTCCAATG
CAGGGACTCAGGGGCAGGGATCTCTGAGAAAGTGGCCATCTCGTTATTAAAGCTCTGTCCTC
TGCTTCCCTCTCACCTCAGAAGCAGCCCGTTTATTCAACAGAGCTCCAGGTTGCCAGCTAGG
GGTTTTCGGGACCATAGACCAAGCAACCCCGAGAGACTGAGTACTGACCTGCAGTTGTTCCAG
AAACTCTGCTGGGAATTAGGTTGTGACCTAGAAGTGAACTGACACTAACAGTGAGAAGGCAG
GGTAAGAATGCAGTCTAGAGCGCAACCTTTCTCCACTAGACTTGTAAGTAATTTAAGTGAAT
CCTGTCCCCCTGGGGTTCTATCCTGGCTGGCTCTGCTGGTGAACTTGACTGGCCAGCATAGG
GCACTTGATGAGACCCTGGAATGCTGAGGCCAGTTGGGCAGCAAGCTTTCACCTCATCCTTC
TGCCCATCTATCCAGCCATTCAAACATTCATTCGCCTGAAGACATTTATCAAGCTCCTGCAA
TGGGTCAGGCATCTGCTAGGCACTGGGGACACAGAGCTCACAGTCTCCTGGAGGGGTGAGA
GATGACTGACAGGTGGTCTGTGGTGCAGTGTGACCTGGGAATGCACACAGTACTGTGGAAAC
ACGGGAGAGGCATCTAGCACAACCTGAGAGGGCCAGGGGAGGCTTCCTGGCAGGTTTCCCTT
TAACCATCTTAAGGGAAAGAGGCACTAGGTAGGAAAATAAAGGGACAGTGGTGTCCCAGACA
GAGGGCACTCTACATGGAA
```

FIGURE 24

```
></usr/seqdb2/sst/DNA/Dnaseqs.min/ss.DNA119530
><subunit 1 of 1, 113 aa, 1 stop
><MW: 12799, pI: 7.53, NX(S/T): 1
MVLCSISLFLIFFHILFLNVSNYFLEVGHQEGHSSLQCRDSGAGISEKVAISLLKLCPLL
PSHLRSSPFIQQSSRLPARGFRDHRPSNPERLSTDLQLFQKLCWELGCDLEVN
```

Important features of the protein:
Signal peptide:
Amino acids    1-18

N-glycosylation site:
Amino acids    19-23

Glycosaminoglycan attachment site:
Amino acids    41-45

N-myristoylation site:
Amino acids    42-48

FIGURE 25

```
CGGGCTCCGCGCGGTCCCACTTCCCGGCTCCCTTCGCCTCCAGGATGCGCTGAGCCCTACAA
CACCCCCAGCGGCCGCCGGCTCCCCACGAGGTGTGAATGACAGAGGTGGTGCCATCCAGCG
CGCTCAGCGAGGTCAGCCTGCGCCTCCTCTGCCACGATGACATAGACACTGTGAAGCACCTG
TGTGGCGACTGGTTCCCCATCGAGTACCCAGACTCATGGTATCGTGATATCACATCCAACAA
GAAGTTCTTTTCCCTTGCTGCAACCTACAGAGGTGCCATTGTGGGAATGATAGTAGCTGAAA
TTAAGAACAGGACCAAAATACATAAAGAGGATGGAGATATTCTAGCAACCAACTTCTCTGTT
GACACACAAGTCGCGTACATCCTAAGTCTGGGCGTCGTGAAAGAGTTCAGGAAGCACGGCAT
AGGTTCCCTCTTACTTGAAAGTTTAAAGGATCACATATCAACCACCGCCCAGGACCACTGCA
AAGCCATTTACCTGCATGTCCTCACCACCAACAACACAGCAATAAACTTCTATGAAAACAGA
GACTTCAAGCAGCACCACTATCTCCCCTATTACTACTCCATTCGAGGGGTCCTCAAAGATGG
CTTCACCTATGTCCTCTACATCAACGGCGGGCACCCTCCCTGGACGATTTTGGACTACATCC
AGCACCTGGGCTCTGCACTAGCCAGCCTGAGCCCCTGCTCCATTCGCACAGAGTCTACCGC
CAGGCCCACAGCCTGCTCTGCAGCTTCCTGCCATGGTCGGGCATCTCTTCCAAGAGTGGCAT
CGAGTACAGCCGGACCATGTGATGTCGGCTGGGCAGCCGCCACCAGGCCCCACCCTTCAGCC
GCCCGCAGAGCCCGCCTTCCTGTCCATCTGACCCCTTCTGTTTTCTGCAAGGAGCTGCCAGC
CATCTAACTGGGCTCGTCGGCCTGCCCCAGCTGCAGGCCCGGTGCTACACGGGCTCGGGAAC
AGAACATCGTGGGCATGCGCAGAGCATGCCCATCCGTGGCAGGCTCTTCAGCTCCCCTCCCT
GCTTCTGGAAACCTCTGCCTGCTGCCCTGGCCCTGCCCCCCTGCGCATGCACCATCCCCAGG
GCTGACCCAGTGTGGCTGCATTCACTGGGAGGGGCCTGCCCTCACTGGGCCTCTCCCACTCCG
CTGCCTGTTCTTGCAGCTCCTTCCTGGAAAGCTGGAGGGGACTTTCTCCTGCAAGGGAGGAA
CGCAAGTATTATGGACACACTTGACCGTAAAGGCACAGGAGCCTCGGAACAAGGGGGCGCAA
TAAAGGGAATGGCCCGTCCCCTTCCAGAACCAGCCCAAAGAAGCCTGGGGGGTGAGGAGTGG
CCCCCACTCCTCCATGAGGGGCTGATGAGGGGTGGGCAGCCTGGGGGAGGCTTTCCTCGCAA
GCACAGAGCTCTGAGGCTCAGCCCCTGGCACAGGCGGTCACGCATCAGGACGGTTCCTACT
CCTCAGCACCTTCCGTGCAGTTACCAGTGCCCTGGGAGGTCACACTGCCCGTCGGACCTTGG
CATGCTCCATTCAGCTGACCTGCTGAGGACAGGCATCGCCGAGACTCCTTGGGTCCTCCCCG
CCCTCCCTCATGCTGCCACAAGCTGCTGCTCCAAGGCCTGGCCACATGCAGACAGGAGGAAG
CTGAGCTCGACATTAGGCCTCAAGGCTGCCATCTGTCTTGTAGGGCCTGGCCTTGTGGGCAG
GGGGCAGTCCTGTGCCTTGTGGGCCCTCAGCCTCTGAGGGCAGAGATGCTGTCAGTGCCGCA
GGTGCATCACATACTTCTAGCATCCTCTCCACCCTGCATTCCAAATGCTGCTTGCTGCCTGC
CCTGCCCTCCGATGCAGGGGTGGGTGGGGGGCGGAGTCCCGCCCAGCATAGCTGCAGTGTC
ACAAAGCCATGGCAGAGGGTCCTAGCGGCGCCACCCTGCCCCAGCCTGAGGAGGAGGGAGAG
GGAGGAACAACCCTGGGCAGACGGGGTCTCAGGGACCTGTGTCCTTCCGCCTCCAGAGCTGC
CCAGCCACGGGCTCTCAGGGTGCTGGGGCAGCCCCAGGTCCCCTCTTGAACTCAGCTGGGGC
CAGGGGCCCTCAGAATGAAGGCAGGCACCAGGCAGGAGCAGCATCCCCCTCCTTGACGGTGC
TGGCAGGAGGGCCGCGCCATGCTGACTGCTTGAACCTCTGCTGACCTGACAGTGCTGGCGGG
AGGGCCGCACCATGCTGACTGCCTGAATCTCTGCTGAGGCTGCCTGCCTGCCGGGCCCAGCT
CAGCGCCCTCTCCACTGCGAATCAGTGGCGATCATGTGATTTCTATTTCTGCCCCACAGGGT
AAGGGACGAGTCTTCTGGAAGGCTCTGCCATGGACATTTGTCCTCGGGCTCAGAGGCCCCAC
CCTGCCCCACACCTGCCCCTAATCACTGCAGTGTCCAGCCCAGTGTTGAACAGATTGTAGCG
TTCTGTCTCATTACGAGCAAATAAATAGACTTTCATTGGGAAAAAAAAAAAA
```

FIGURE 26

```
></usr/seqdb2/sst/DNA/Dnaseqs.min/ss.DNA121772
><subunit 1 of 1, 242 aa, 1 stop
><MW: 27465, pI: 7.72, NX(S/T): 3
MTEVVPSSALSEVSLRLLCHDDIDTVKHLCGDWFPIEYPDSWYRDITSNKKFFSLAATYR
GAIVGMIVAEIKNRTKIHKEDGDILATNFSVDTQVAYILSLGVVKEFRKHGIGSLLLESL
KDHISTTAQDHCKAIYLHVLTTNNTAINFYENRDFKQHHYLPYYYSIRGVLKDGFTYVLY
INGGHPPWTILDYIQHLGSALASLSPCSIPHRVYRQAHSLLCSFLPWSGISSKSGIEYSR
TM N-glycosylation sites:
Amino acids      73-77;88-92;143-147

N-myristoylation sites:
Amino acids      61-67;65-71;198-204;235-241

Matrixins cysteine switch motif:
Amino acids      18-31
```

FIGURE 27

GTTGGGCAGCAGCCACCCGCTCACCTCCATCCCCAGGACTTAGAGGGACGCAGGGCGTTGGG
AACAGAGGACACTCCAGGCGCTGACCCTGGGAGGCCAGGACCAGGGCCAAAGTCCCGTGGGC
AAGAGGAGTCCTCAGAGGTCCTTCATTCAGCGGTTCCGGGAGGTCTGGGAAGCCCACGGCCT
GGCTGGGGCAGGGTCAACGCCGCCAGGCCGCCATGGTCCTGTGCTGGCTGCTGCTTCTGGTG
ATGGCTCTGCCCCAGGCACGACGGGCGTCAAGGACTGCGTCTTCTGTGAGCTCACCGACTC
CATGCAGTGTCCTGGTACCTACATGCACTGTGGCGATGACGAGGACTGCTTCACAGGCCACG
GGGTCGCCCCGGGCACTGGTCCGGTCATCAACAAAGGCTGCCTGCGAGCCACCAGCTGCGGC
CTTGAGGAACCCGTCAGCTACAGGGGCGTCACCTACAGCCTCACCACCAACTGCTGCACCGG
CCGCCTGTGTAACAGAGCCCCGAGCAGCCAGACAGTGGGGGCCACCACCAGCCTGGCACTGG
GGCTGGGTATGCTGCTTCCTCCACGTTTGCTGTGACCAACAGGGAGGACAGGGCCTGGGACT
GTTCTCCCAGATCCGCCACTCCCCATGTCCCCATGTCCTTCCCCCACTAAATGGCCAGAGAG
GCCCTGGACAACCTCTTGCGGCCCTGGCTTCATCCCTTCTAAGGCTGTCCACCAGGAGCCCG
GTGCTAGGGGAAGCATCCCCAGGCCTGACTGAGCGGCAGGGGAGCACGGCCCGTGGGTTTGA
TTGTATTACTCTGTTCCACTGGTTCTAAGACGCAGAGCTTCTCACATCTCAATCAGGATGCT
TCTCTCCATTGGTAGCACTTTAGAGTCCATGAAATATGGTAAAAAATATATATATATCATAA
TAAATGACAGCTGATGTTCATGGGGGAAAAAAAAAAAAAAAAAAAAAAAAAAAAAAAAAAAA

FIGURE 28

></usr/seqdb2/sst/DNA/Dnaseqs.min/ss.DNA125148
><subunit 1 of 1, 124 aa, 1 stop
><MW: 13004, pI: 5.70, NX(S/T): 0
MVLCWLLLLVMALPPGTTGVKDCVFCELTDSMQCPGTYMHCGDDEDCFTGHGVAPGTGPV
INKGCLRATSCGLEEPVSYRGVTYSLTTNCCTGRLCNRAPSSQTVGATTSLALGLGMLLP
PRLL

Important features of the protein:
Signal peptide:
Amino acids    1-13

N-myristoylation sites:
Amino acids    19-25;52-58;64-70;81-87;106-112

Ly-6 / u-PAR domain proteins:
Amino acids    84-97

FIGURE 29

```
GGCATTTTGAAAGCCCAGTGTTGCCCAGGGGGCATCTCCTTTGTGTTTATGAGAGACCTGCA
TTCTCCCTGGCTCAGTTCTCTCAGGCTCTCCAGAGCTCAGGACCTCTGAGAAGAATGGAGCC
CTCCTGGCTTCAGGAACTCATGGCTCACCCCTTCTTGCTGCTGATCCTCCTCTGCATGTCTC
TGCTGCTGTTTCAGGTAATCAGGTTGTACCAGAGGAGGAGATGGATGATCAGAGCCCTGCAC
CTGTTTCCTGCACCCCCTGCCCACTGGTTCTATGGCCACAAGGAGTTTTACCCAGTAAAGGA
GTTTGAGGTGTATCATAAGCTGATGGAAAAATACCCATGTGCTGTTCCCTTGTGGGTTGGAC
CCTTTACGATGTTCTTCAGTGTCCATGACCCAGACTATGCCAAGATTCTCCTGAAAAGACAA
GATCCCAAAAGTGCTGTTAGCCACAAAATCCTTGAATCCTGGGTTGGTCGAGGACTTGTGAC
CCTGGATGGTTCTAAATGGAAAAAGCACCGCCAGATTGTGAAACCTGGCTTCAACATCAGCA
TTCTGAAAATATTCATCACCATGATGTCTGAGAGTGTTCGGATGATGCTGAACAAATGGGAG
GAACACATTGCCCAAAACTCACGTCTGGAGCTCTTTCAACATGTCTCCCTGATGACCCTGGA
CAGCATCATGAAGTGTGCCTTCAGCCACCAGGGCAGCATCCAGTTGGACAGTACCCTGGACT
CATACCTGAAAGCAGTGTTCAACCTTAGCAAAATCTCCAACCAGCGCATGAACAATTTTCTA
CATCACAACGACCTGGTTTTCAAATTCAGCTCTCAAGGCCAAATCTTTTCTAAATTTAACCA
AGAACTTCATCAGTTCACAGAGAAAGTAATCCAGGACCGGAAGGAGTCTCTTAAGGATAAGC
TAAAACAAGATACTACTCAGAAAAGGCGCTGGGATTTTCTGGACATACTTTTGAGTGCCAAA
AGCGAAAACACCAAAGATTTCTCTGAAGCAGATCTCCAGGCTGAAGTGAAAACGTTCATGTT
TGCAGGACATGACACCACATCCAGTGCTATCTCCTGGATCCTTTACTGCTTGGCAAAGTACC
CTGAGCATCAGCAGAGATGCCGAGATGAAATCAGGGAACTCCTAGGGGATGGGTCTTCTATT
ACCTGGGAACACCTGAGCCAGATGCCTTACACCACGATGTGCATCAAGGAATGCCTCCGCCT
CTACGCACCGGTAGTAAACATATCCCGGTTACTCGACAAACCCATCACCTTTCCAGATGGAC
GCTCCTTACCTGCAGGAATAACTGTGTTTATCAATATTTGGGCTCTTCACCACAACCCCTAT
TTCTGGGAAGACCCTCAGGTCTTTAACCCCTTGAGATTCTCCAGGGAAAATTCTGAAAAAAT
ACATCCCTATGCCTTCATACCATTCTCAGCTGGATTAAGGAACTGCATTGGGCAGCATTTTG
CCATAATTGAGTGTAAAGTGGCAGTGGCATTAACTCTGCTCCGCTTCAAGCTGGCTCCAGAC
CACTCAAGGCCTCCCCAGCCTGTTCGTCAAGTTGTCCTCAAGTCCAAGAATGGAATCCATGT
GTTTGCAAAAAAGTTTGCTAATTTTAAGTCCTTTCGTATAAGAATTAATGAGACAATTTTCCT
ACCAAAGGAAGAACAAAAGGATAAATATAATACAAAATATATGTATATGGTTGTTTGACAAA
TTATATAACTTAGGATACTTCTGACTGGTTTTGACATCCATTAACAGTAATTTTAATTTCTT
TGCTGTATCTGGTGAAACCCACAAAAACACCTGAAAAAACTCAAGCTGACTTCCACTGCGAA
GGGAAATTATTGGTTTGTGTAACTAGTGGTAGAGTGGCTTTCAAGCATAGTTTGATCAAAAC
TCCACTCAGTATCTGCATTACTTTTATCTCTGCAAATATCTGCATGATAGCTTTATTCTCAG
TTATCTTTCCCCATAATAAAAATATCTGCCAAA
```

FIGURE 30

```
></usr/seqdb2/sst/DNA/Dnaseqs.min/ss.DNA125150
><subunit 1 of 1, 505 aa, 1 stop
><MW: 59086, pI: 9.50, NX(S/T): 3
MEPSWLQELMAHPFLLLILLCMSLLLFQVIRLYQRRRWMIRALHLFPAPPAHWFYGHKEF
YPVKEFEVYHKLMEKYPCAVPLWVGPFTMFFSVHDPDYAKILLKRQDPKSAVSHKILESW
VGRGLVTLDGSKWKKHRQIVKPGFNISILKIFITMMSESVRMMLNKWEEHIAQNSRLELF
QHVSLMTLDSIMKCAFSHQGSIQLDSTLDSYLKAVFNLSKISNQRMNNFLHHNDLVFKFS
SQGQIFSKFNQELHQFTEKVIQDRKESLKDKLQDTTQKRRWDFLDILLSAKSENTKDFS
EADLQAEVKTFMFAGHDTTSSAISWILYCLAKYPEHQQRCRDEIRELLGDGSSITWEHLS
QMPYTTMCIKECLRLYAPVVNISRLLDKPITFPDGRSLPAGITVFINIWALHHNPYFWED
PQVFNPLRFSRENSEKIHPYAFIPFSAGLRNCIGQHFAIIECKVAVALTLLRFKLAPDHS
RPPQPVRQVVLKSKNGIHVFAKKVC Important features of the protein:
Signal peptide:
Amino acids    1-28

Transmembrane domain:
Amino acids    451-470

N-glycosylation sites:
Amino acids    145-149;217-221;381-385 cAMP- and cGMP-dependent protein kinase phosphorylation site:
Amino acids    264-268

N-myristoylation sites:
Amino acids    243-249;351-357;448-454;454-460

Cytochrome P450 cysteine heme-iron ligand signature:
Amino acids    445-455

Cytochrome P450 cysteine heme-iron ligand proteins:
Amino acids    442-473

FAD-dependent glycerol-3-phosphate dehydrogenase proteins:
Amino acids    124-141
```

FIGURE 31

```
TCCGCTGTCGCCCAGTCCCGGCCGCTGGCGGGAACTGACCTGGAGCAAGCAGGACCTTCCCT
CCCACCTCTCCCGCCTGGCCTCCGCGGGAGTCCCCTACGATCCCGCTCAGCAGTGGGGCACT
CGCTGAGGACAGCGAGTCCTGGGAGTGAGCCCAAGGCCACCCCTGGCCAGCCCAGGAGAGAT
AGCCAGGGCAGGCCCAGCAGCCCGAGGCCAGGCTCTGGCCACGGCGGTCTCCGACATGGAGA
GACATTGTCTGCTTTTTATCCTGTTAACCTGTCTTCGGTGGTTGTGCCACGACATTCCCCAG
GGTTCAGGTGCCCGGTGGCCGAGGGTCAGTCCAGTGGTAGAGCCTTGCTCTCCTAGGCTCAT
CCTGCTGGCGGTCCTCCTGCTTCTGCTGTGTGGTGTCACAGCTGGTTGTGTCCGGTTCTGCT
GCCTCCGGAAGCAGGCACAGGCCCAGCCACATCTGCCACCAGCACGGCAGCCCTGCGACGTG
GCAGTCATCCCTATGGACAGTGACAGCCCTGTACACAGCACTGTGACCTCCTACAGCTCCGT
GCAGTACCCACTGGGCATGCGGTTGCCCCTGCCCTTTGGGGAGCTGGACCTGGACTCCACGG
CTCCTCCTGCCTACAGCCTGTACACCCCGGAGCCTCCACCCTCCTACGATGAAGCTGTCAAG
ATGGCCAAGCCCAGAGAGGAAGGACCAGCACTCTCCCAGAAACCCAGCCCTCTCCTTGGGGC
CTCGGGCCTAGAGACCACTCCAGTGCCCCAGGAGTCGGGCCCCAATACTCAACTACCACCTT
GTAGCCCTGGTGCCCCTTGAAGGAGGTAGGAGAACGGACCAGAGCTTGGAGAACTAATGCTT
GGAGCCAAGGGCCCCAGCCCACCCCACCGTCCCACACATTGCTGTGGCCCCAACCTCGGTGC
CATGTTACACCGGCCCCTGGCGTCACCCACTAGGCAGGCTGCTGCTTTCAGCCTCAGCCCCT
GGCCCAGCCCCAGCAGGCCCTCAGCCTGGAAGAGGCCCCTTGGGCCTAAGCCTCGGGTGGGA
GCTCAGGGCCACCTGTGACGTCTGCATCTTCTTGGAGAGAGAATAAAGTTTGTATTTAAGTGGT
```

FIGURE 32

```
></usr/seqdb2/sst/DNA/Dnaseqs.min/ss.DNA125151
><subunit 1 of 1, 194 aa, 1 stop
><MW: 20882, pI: 6.44, NX(S/T): 0
MERHCLLFILLTCLRWLCHDIPQGSGARWPRVSPVVEPCSPRLILLAVLLLLLCGVTAGC
VRFCCLRKQAQAQPHLPPARQPCDVAVIPMDSDSPVHSTVTSYSSVQYPLGMRLPLPFGE
LDLDSTAPPAYSLYTPEPPPSYDEAVKMAKPREEGPALSQKPSPLLGASGLETTPVPQES
GPNTQLPPCSPGAP
```

Important features of the protein:
Signal peptide:
Amino acids    1-20

Transmembrane domain:
Amino acids    39-58

N-myristoylation site:
Amino acids    55-61

Prokaryotic membrane lipoprotein lipid attachment site:
Amino acids    50-61

FIGURE 33

CCTTGCTTGGTGCTTGGCACACACAAATCCAGTGGGCTACACAGGTTTTCCAGAAGCCCCAC
GAGGTGGTAATGGTGCTGCTGATTCAGACCCTGGGGGCCCTCATGCCCTCGCTGCCCTCCTG
CCTCAGCAACGGCGTGGAGAGGGCAGGGCCCGAGCAGGAGCTCACCAGGCTGCTGGAGTTCT
ACGACGCCACCGCCCACTTCGCCAAGGGCTTGGAGATGGCACTGCTCCCCACCTACATGAA
CACAATCTGGTAAAAGTCACGGAGCTGGTGGATGCTGTGTATGATCCATACAAACCCTACCAG
CTGAAGTATGGCGACATGGAAGAGAGCAACCTCCTCATCCAGATGAGTGCTGTGCCTCTGGA
GCATGGGAAGTGATTGACTGTGTGCAGGAGCTGAGCCACTCCGTGAACAAGCTGTTTGGTC
TGGCGTCTGCAGCCGTTGACAGATGCGTCAGATTCACCAATGGCCTGGGGACCTGCGGCCTG
TTGTCAGCCCTGAAATCCCTCTTTGCCAAGTATGTGTCTGATTTCACCAGCACTCTCCAGTC
CATACGAAAGAAGTGCAAACTGGACCACATTCCTCCCAACTCCCTCTTCCAGGAAGATTGGA
CGGCTTTTCAGAACTCCATTAGGATAATAGCCACCTGTGGAGAGCTTTTGCGGCATTGTGGG
GACTTCGAGCAGCAGCTAGCCAACAGGATTTTGTCCACAGCTGGGAAGTATCTATCTGATTC
CTGCAGCCCCGGAGCCTGGCTGGTTTTCAGGAGAGCATCTTGACAGACAAGAAGAACTCTG
CCAAGAACCCATGGCAAGAATATAATTACCTCCAGAAAGATAACCCTGCTGAATATGCCAGT
TTAATGGAAATACTTTATACCCTTAAGGAAAAAGGGTCAAGCAACCACAACCTGCTGGCTGC
ACCTCGAGCAGCGCTGACTCGGCTTAACCAGCAGGCCCACCAGCTGGCTTTCGATTCCGTGT
TCCTGCGCATCAAACAACAGCTGTTGCTTATTTCGAAGATGGACAGCTGGAATACGGCTGGC
ATCGGAGAAACCCTCACAGATGAACTGCCCGCCTTTAGTCTCACCCCTCTCGAGTACATCAG
CAACATCGGGCAGTACATCATGTCCCTCCCCCTGAATCTTGAGCCATTTGTGACTCAGGAGG
ACTCTGCCTTAGAGTTGGCATTGCACGCTGGAAAGCTGCCATTTCCTCCTGAGCAGGGGGAT
GAATTGCCCGAGCTGGACAACATGGCTGACAACTGGCTGGGCTCGATCGCCAGAGCCACAAT
GCAGACCTACTGTGATGCGATCCTACAGATCCCTGAGCTGAGCCCACACTCTGCCAAGCAGC
TGGCCACTGACATCGACTATCTGATCAACGTGATGGATGCCCTGGGCCTGCAGCCGTCCCGC
ACCCTCCAGCACATCGTGACGCTACTGAAGACCAGGCCTGAGGACTATAGACAGGTCAGCAA
AGGCCTGCCCCGTCGCCTGGCCACCACCGTGGCCACCATGCGGAGTGTGAATTACTGACCCC
ACCACACACCGGACCACCAAGAGAGCCAGGGCTGCTGTTTCGTGACTCACCAGCACAGATTT
GCTCAGAAACTCTGCCCAAGATTGGGCAGAAGTTACTTTAAAAAGACTTGGTTCAGCTGGTC
ACGGTGGCTCACGCCTGTAATCCCAGCACTTTGGGAGGCCAAGCCAGATGGATCATGAGGCC
AGGAGTTCGAGACCAGCCTGACCAACATGGTGAAACCCCATCTCTACTAAAAATACAAAAAT
TAACAGCAGAGCGAGACTCTGTCTCAAAAAAAAAAAAAAAAAAGACTTGGTTCATTTGTATAA
TCAAAAAGAGTTGTAAATTAAAGATGTATTATTTATCAGAGAAGACTTTTTAGATAATTTTT
TTAAAGGATCAGATCTTGAAAATGGAATAAATAACTACTGTGAAATGCAAAAA

FIGURE 34

```
></usr/seqdb2/sst/DNA/Dnaseqs.min/ss.DNA125181
><subunit 1 of 1, 491 aa, 1 stop
><MW: 54759, pI: 5.61, NX(S/T): 0
MVLLIQTLGALMPSLPSCLSNGVERAGPEQELTRLLEFYDATAHFAKGLEMALLPHLHEH
NLVKVTELVDAVYDPYKPYQLKYGDMEESNLLIQMSAVPLEHGEVIDCVQELSHSVNKLF
GLASAAVDRCVRFTNGLGTCGLLSALKSLFAKYVSDFTSTLQSIRKKCKLDHIPPNSLFQ
EDWTAFQNSIRIIATCGELLRHCGDFEQQLANRILSTAGKYLSDSCSPRSLAGFQESILT
DKKNSAKNPWQEYNYLQKDNPAEYASLMEILYTLKEKGSSNHNLLAAPRAALTRLNQQAH
QLAFDSVFLRIKQQLLLISKMDSWNTAGIGETLTDELPAFSLTPLEYISNIGQYIMSLPL
NLEPFVTQEDSALELALHAGKLPFPPEQGDELPELDNMADNWLGSIARATMQTYCDAILQ
IPELSPHSAKQLATDIDYLINVMDALGLQPSRTLQHIVTLLKTRPEDYRQVSKGLPRRLA
TTVATMRSVNY Important features of the protein:
Signal peptide:
Amino acids      1-20 cAMP- and cGMP-dependent protein kinase phosphorylation site:
Amino acids      242-246

N-myristoylation sites:
Amino acids      22-28;48-54;121-127;136-142;141-147;328-334;
                 447-453

Leucine zipper pattern:
Amino acids      295-317
```

FIGURE 35

```
GCAAGTGCCACCATGCTAGTGTGATTTGGACTTCAGTAAAAGTTAGTTTGCTTCCTTCCCGT
TGTCCCATCTCACTCCTGGGCCACCCATGGGGCTGCTGGTAGCTGGTGTGTGGCTGCTGCTG
GACTGTGTGGCAGTCCATCCATCTGTCAGCAGCCACTGCGGGCCTACTTGCTGGGTGCCCAG
CACCGCACTCACCACTGCAGGCGTGGCCAGGAGCGTGAGATCCCCAGAGCCCATGGCCAGTG
AGAGGCGGCCAGGGATAGGTACCCAGGGAATGCCACAGGAGTTTGCTGGGCTCACGGAGCTC
TTTCACTGGTCAGAGAGGAGTGTGTGTAGGAGAGGACTTCTACTTGGTGTTGAAGGACAGAT
GGGGTTTGGCTGGGAGAGAGGAGGAATGTGGGCGGGCCTTATAGGCAGGCGAGAAGGTGAGA
GCCAAGGCCCTCTGTGGGCAGGGCGAGGTGGCGTGTTGAGGAGACTCGTCCAGCTGGGCAGA
GGCTCATGTTGAGGGATGAGGCAGAGCTGGGGGAGGAGGGAGCCCAGAAATGGCAGGTCCTT
GAATGCAGGTTTGGAAGCAGGGACGCCCTGTGAGGGTACAGAGTCTGGGCTGTTACCTTCTG
TGGCTTTTGCTAGAAGGTGAGATGTCAGGGAGGAAGACAGGACTCCAGGATGTCTCCTGTCTCT
CTCTGGAAAAAGGAGGTGGGCCCCTTTCTCAGCAGTCAGCTGCTGTTTTTGAGGTCTTCTCC
ATGGATAATCCACGGTGTTGGAAGTGGTTAAGGTAATGGATCCTCATGGGCTTACCATAAAA
ATATCTGGAGGCTGGACCATTTTCCTTAAAACGTTATAAAAGCTGGAATTGAATGCCATCGG
TGTCACCCCTGGGAAGTGTGCTTTCTCTTGAGCTCTTTTGGCCCCGAGATAGCAGTCACTCC
ATAGTTTCGTGAAGACCAGCCTGGTGTTGCCTGGTTTTCTGCCATTAGGGAGCAGCTAGAGG
TCTTCCAGTAGCTCCTGTGTAAAGTGATGAAAGAAAAGGGCTGGGTGCTGACTGCTCCTGGA
GAAAAGCAACACACTCCCAAAGTCTTAATTGCCTGCTTCCAGGGAGCTGTGGTGGTTTCCCT
TGGGCAGGGCACACGCCCAGTGGTTGACTTAATAAGGATACATTTTAATCAGAGGACAAAA
ATGTGCCCTGACTTGATTTCCGCATGGGCTTCCAGCATGGTCAAAGG
```

FIGURE 36

></usr/seqdb2/sst/DNA/Dnaseqs.min/ss.DNA125192
><subunit 1 of 1, 139 aa, 1 stop
><MW: 14841, pI: 9.20, NX(S/T): 0
MGLLVAGVWLLLDCVAVHPSVSSHCGPTCWVPSTALTTAGVARSVRSPEPMASERRPGIG
TQGMPQEFAGLTELFHWSERSVCRRGLLLGVEGQMGFGWERGGMWAGLIGRREGESQGPL
WAGRGGVLRRLVQLGRGSC

Important features of the protein:
Signal peptide:
Amino acids     1-22

N-myristoylation sites:
Amino acids     2-8;40-46;86-92;102-108;103-109

Amidation site:
Amino acids     109-113

FIGURE 37

```
GGCCAGGAATGGGGTCCCCGGGCATGGTGCTGGGCCTCCTGGTGCAGATCTGGGCCCTGCAA
GAAGCCTCAAGCCTGAGCGTGCAGCAGGGGCCCAACTTGCTGCAGGTGAGGCAGGGCAGTCA
GGCGACCCTGGTCTGCCAGGTGGACCAGGCCACAGCCTGGGAACGGCTCCGTGTTAAGTGGACA
AAGGATGGGGCCATCCTGTGTCAACCGTACATCACCAACGGCAGCCTCAGCCTGGGGGTCTG
CGGGCCCCAGGGACGGCTCTCCTGGCAGGCACCCAGCCATCTCACCCTGCAGCTGGACCCTG
TGAGCCTCAACCACAGCGGGGCGTACGTGCTGGGCGGCCGTAGAGATTCCTGAGTTGGAG
GAGGCTGAGGGCAACATAACAAGGCTCTTTGTGGACCCAGATGACCCCACACAGAACAGAAA
CCGGATCGCAAGCTTCCCAGGATTCCTCTTCGTGCTGCTGGGGGTGGGAAGCATGGGTGTGG
CTGCGATCGTGTGGGGTGCCTGGTTCTGGGGCCGCCGCAGCTGCCAGCAAAGGGACTCAGGA
AATGCATTCTACAGCAACGTCCTATACCGGCCCCGGGGGGCCCCAAAGAAGAGTGAGGACTG
CTCTGGAGAGGGGAAGGACCAGAGGGGCCAGAGCATTTATTCAACCTCCTTCCCGCAACCGG
CCCCCCGCCAGCCGCACCTGGCGTCAAGACCCTGCCCCAGCCCGAGACCCTGCCCCAGCCCC
AGGCCCGGCCACCCCGTCTCTATGGTCAGGGTCTCTCCTAGACCAAGCCCCACCCAGCAGCC
GAGGCCAAAAGGGTTCCCCAAAGTGGGAGAGGAGTGAGAGATCCCAGGAGACCTCAACAGGA
CCCCACCCATAGGTACACACAAAAAAGGGGGATCGAGGCCAGACACGGTGGCTCACGCCTG
TAATCCCAGCAGTTTGGGAAGCCGAGGCGGGTGGAACACTTGAGGTCAGGGGTTTGAGACCA
GCCTGGCTTGAACCTGGGAGGCGGAGGTTGCAGTGAGCCGAGATTGCGCCACTGCACTCCAG
CCTGGGCGACAGAGTGAGACTCCGTCTCAAAAAAAAAACAAAAAGCAGGAGGATTGGGAGCC
TGTCAGCCCCATCCTGAGACCCCGTCCTCATTTCTGTAATGATGGATCTCGCTCCCACTTTC
CCCCAAGAACCTAATAAAGGCTTGTGAAGAAAAAAAAAAAAAAA
```

FIGURE 38

```
></usr/seqdb2/sst/DNA/Dnaseqs.min/ss.DNA125196
><subunit 1 of 1, 278 aa, 1 stop
><MW: 30319, pI: 9.21, NX(S/T): 3
MGSPGMVLGLLVQIWALQEASSLSVQQGPNLLQVRQGSQATLVCQVDQATAWERLRVKWT
KDGAILCQPYITNGSLSLGVCGPQGRLSWQAPSHLTLQLDPVSLNHSGAYVCWAAVEIPE
LEEAEGNITRLFVDPDDPTQNRNRIASFPGFLFVLLGVGSMGVAAIVWGAWFWGRRSCQQ
RDSGNAFYSNVLYRPRGAPKKSEDCSGEGKDQRGQSIYSTSFPQPAPRQPHLASRPCPSP
RPCPSPRPGHPVSMVRVSPRPSPTQQPRPKGFPKVGEE
```

Important features of the protein:
Signal peptide:
Amino acids    1-22

Transmembrane domain:
Amino acids    149-166

N-glycosylation sites:
Amino acids    73-77;105-109;127-131

Glycosaminoglycan attachment site:
Amino acids    206-210

N-myristoylation sites:
Amino acids    5-11;37-43;63-69;108-114

Amidation site:
Amino acids    173-179

FIGURE 39

ACCAGCAGAAGGCTGGGAGTCTGTAGTTTGTTCCTGCTGCCAGGCTCCACTGAGGGGAACGG
GGACCTGTCTGAAGAGAAGATGCCCCTGCTGACACTCTACCTGCTCCTCTTCTGGCTCTCAG
GCTACTCCATTGCCACTCAAATCACCGGTCCAACAACAGTGAATGGCTTGGAGCGGGCTCC
TTGACCGTGCAGTGTGTTTACAGATCAGGCTGGGAGACCTACTTGAAGTGGTGGTGTCGAGG
AGCTATTTGGCGTGACTGCAAGATCCTTGTTAAAACCAGTGGGTCAGAGCAGGAGGTGAAGA
GGGACCGGGTGTCCATCAAGGACAATCAGAAAAACCGCACGTTCACTGTGACCATGGAGGAT
CTCATGAAAACTGATGCTGACACTTACTGGTGTGGAATTGAGAAACTGGAAATGACCTTGG
GGTCACAGTTCAAGTGACCATTGACCCAGCACCAGTCACCCAAGAAGAAACTAGCAGCTCCC
CAACTCTGACCGGCCACCACTTGGACAACAGGCACAAGCTCCTGAAGCTCAGTGTCCTCCTG
CCCCTCATCTTCACCATATTGCTGCTGCTTTTGGTGGCCGCCTCACTCTTGGCTTGGAGGATG
ATGAAGTACCAGCAGAAAGCAGCCGGGATGTCCCCAGAGCAGGTACTGCAGCCCCTGGAGGG
CGACCTCTGCTATGCAGACCTGACCCTGCAGCTGGCCGGAACCTCCCCGCGAAAGGCTACCA
CGAAGCTTTCCTCTGCCCAGGTTGACCAGGTGGAAGTGGAATATGTCACCATGGCTTCCTTG
CCGAAGGAGGACATTTCCTATGCATCTCTGACCTTGGGTGCTGAGGATCAGGAACCGACCTA
CTGCAACATGGGCCACCTCAGTAGCCACCTCCCCGGCAGGGGCCCTGAGGAGCCCACGGAAT
ACAGCACCATCAGCAGGCCTTAGCCTGCACTCCAGGCTCCTTCTTGCACCCCAGGCTGTGAG
CACACTCCTGCCTCATCGACCGTCTGCCCCCTGCTCCCCTCATCAGGACCAACCCGGGGACT
GGTGCCTCTGCCTGATCAGCCAGCATTGCCCCTAGCTCTGGGTTGGGCTTGGGGCCAAGTCT
CAGGGGGCTTCTAGGAGTTGGGGTTTTCTAAACGTCCCCTCCTCTCCTACATAGTTGAGGAG
GGGGCTAGGGATATGCTCTGGGGCTTTCATGGGAATGATGAAGATGATAATGAGAAAAATGT
TATCATTATTATCATGAAGTACCATTATCATAATACAATGAACCTTTATTTATTGCCTACCA
CATGTTATGGGCTGAATAATGGCCCCCAAAGATATCTGTGTCCTAATCCTCAGAACTTGTGA
CTGTTACCTTCTGTGGCAGAAAGGGACAGTGCAGATGTATGTAAGTTAAGGACTTTGAGATA
GAGAGGTTATTCTTGCTGATTCAGGTGGGCCCAAAATATCACCACAAGGGTCCTCATAAGAA
AGAGGCCAGAAGGTCAAAGAGGTAGAGACAAAGTGATGATGGAAGTGGACGTGGGTGTGACG
TGAGCAGGGGCCATGAATGCCGCAGCCTTCAGATGCCAGAAAGGGAAAGGAATGGATTCCCC
TGCCTGGAGCCTCCAAAAGAAACCAGCCCTGCCCACGCCTTGACTTGAGCCCATTGAAACTG
ATCTTGAGCTCCTGGCCTCCAGAATTGCAGGAGAATAAATTTGTGTTGTTTTTAATGAAAAA
AAAAAAAAAAAAAAAAAAAAAAAAAAAAAAAAAAAAAAAAAAAAAAAAAAAAAAAAAAAAAA
AAAAAAAAAAAAAAAAAAAAAAAAAAAAAAAAAAAG

FIGURE 40

```
></usr/seqdb2/sst/DNA/Dnaseqs.min/ss.DNA125200
><subunit 1 of 1, 290 aa, 1 stop
><MW: 32335, pI: 5.82, NX(S/T): 1
MPLLTLYLLLFWLSGYSIATQITGPTTVNGLERGSLTVQCVYRSGWETYLKWWCRGAIWR
DCKILVKTSGSEQEVKRDRVSIKDNQKNRTFTVTMEDLMKTDADTYWCGIEKTGNDLGVT
VQVTIDPAPVTQEETSSSPTLTGHHLDNRHKLLKLSVLLPLIFTILLLLLVAASLLAWRM
MKYQQKAAGMSPEQVLQPLEGDLCYADLTLQLAGTSPRKATTKLSSAQVDQVEVEYVTMA
SLPKEDISYASLTLGAEDQEPTYCNMGHLSSHLPGRGPEEPTEYSTISRP
```

Important features of the protein:
Signal peptide:
Amino acids     1-15

Transmembrane domain:
Amino acids     155-174

N-glycosylation site:
Amino acids     88-92 cAMP- and cGMP-dependent protein kinase phosphorylation site:
Amino acids     218-222

Tyrosine kinase phosphorylation site:
Amino acids     276-285

N-myristoylation sites:
Amino acids     30-36;109-115;114-120

FIGURE 41

```
AAGAACACTGTTGCTCTTGGTGGACGGGCCCAGAGGAATTCAGAGTTAAACCTTGAGTGCCT
GCGTCCGTGAGAATTCAGCATGGAATGTCTCTACTATTTCCTGGGATTTCTGCTCCTGGCTG
CAAGATTGCCACTTGATGCCGCCAAACGATTTCATGATGTGCTGGGCAATGAAAGACCTTCT
GCTTACATGAGGGAGCACAATCAATTAAATGGCTGGTCTTCTGATGAAAATGACTGGAATGA
AAAACTCTACCCAGTGTGGAAGCGGGGAGACATGAGGTGGAAAAACTCCTGGAAGGGAGGCC
GTGTGCAGGCGGTCCTGACCAGTGACTCACCAGCCCTCGTGGGCTCAAATATAACATTTGCG
GTGAACCTGATATTCCCTAGATGCCAAAAGGAAGATGCCAATGGCAACATAGTCTATGAGAA
GAACTGCAGAAATGAGGCTGGTTTATCTGCTGATCCGTATGTTACAACTGGACAGCATGGT
CAGAGGACAGTGACGGGGAAAATGGCACCGGCCAAAGCCATCATAACGTCTTCCCTGATGGG
AAACCTTTTCCTCACCACCCCGGATGGAGAAGATGGAATTTCATCTACGTCTTCCACACACTT
GGTCAGTATTTCCAGAAATTGGGACGATGTTCAGTGAGAGTTTCTGTGAACACAGCCAATGT
GACACTTGGGCCTCAACTCATGGAAGTGACTGTCTACAGAAGACATGGACGGGCATATGTTC
CCATCGCACAAGTGAAAGATGTGTACGTGGTAACAGATCAGATTCCTGTGTTTGTGACTATG
TTCCAGAAGAACGATCGAAATTCATCCGACGAAACCTTCCTCAAAGATCTCCCCATTATGTT
TGATGTCCTGATTCATGATCCTAGCCACTTCCTCAATTATTCTACCATTAACTACAAGTGGA
GCTTCGGGGATAATACTGGCCTGTTTGTTTCCACCAATCATACTGTGAATCACACGTATGTG
CTCAATGGAACCTTCAGCCTTAACCTCACTGTGAAAGCTGCAGCACCAGGACCTTGTCCGCC
ACCGCCACCACCACCCAGACCTTCAAAACCCACCCCTTCTTTAGCAACTACTCTAAAATCTT
ATGATTCAAACACCCCAGGACCTACTGGTGACAACCCCCTGGAGCTGAGTAGGATTCCTGAT
GAAAACTGCCAGATTAACAGATATGGCCACTTTCAAGCCACCATCACAATTGTAGAGGGAAT
CTTAGAGGTTAACATCATCCAGATGACAGACGTCCTGATGCCGGTGCCATGGCCTGAAAGCT
CCCTAATAGACTTTGTCGTGACCTGCCAAGGGAGCATTCCCACGGAGGTCTGTACCATCATT
TCTGACCCCACCTGCGAGATCACCCAGAACACAGTCTGCAGCCCTGTGGATGTGGATGAGAT
GTGTCTGCTGACTGTGAGACGAACCTTCAATGGGTCTGGGACGTACTGTGTGAACCTCACCC
TGGGGGATGACACAAGCCTGGCTCTCACGAGCACCCTGATTTCTGTTCCTGACAGAGACCCA
GCCTCGCCTTTAAGGATGGCAAACAGTGCCCTGATCTCCGTTGGCTGCTTGGCCATATTTGT
CACTGTGATCTCCCTCTTGGTGTACAAAAAACACAAGGAATACAACCCAATAGAAAATAGTC
CTGGGAATGTGGTCAGAAGCAAAGGCCTGAGTGTCTTTCTCAACCGTGCAAAAGCCGTGTTC
TTCCCGGGAAACCAGGAAAAGGATCCGCTACTCAAAAACCAAGAATTTAAAGGAGTTTCTTA
AATTTCGACCTTGTTTCTGAAGCTCACTTTTCAGTGCCATTGATGTGAGATGTGCTGGAGTG
GCTATTAACCTTTTTTTCCTAAAGATTATTGTTAAATAGATATTGTGGTTTGGGGAAGTTGA
ATTTTTTATAGGTTAAATGTCATTTTAGAGATGGGGAGAGGGATTATACTGCAGGCAGCTTC
AGCCATGTTGTGAAACTGATAAAAGCAACTTAGCAAGGCTTCTTTTCATTATTTTTTATGTT
TCACTTATAAAGTCTTAGGTAACTAGTAGGATAGAAACACTGTGTCCCGAGAGTAAGGAGAG
AAGCTACTATTGATTAGAGCCTAACCCAGGTTAACTGCAAGAAGAGGCGGGATACTTTCAGC
TTTCCATGTAACTGTATGCATAAAGCCAATGTAGTCCAGTTTCTAAGATCATGTTCCAAGCTA
ACTGAATCCCACTTCAATACACACTCATGAACTCCTGATGGAACAATAACAGGCCCAAGCCT
GTGGTATGATGTGCACACTTGCTAGACTCAGAAAAAATACTACTCTCATAAATGGGTGGGAG
TATTTTGGTGACAACCTACTTTGCTTGGCTGAGTGAAGGAATGATATTCATATATTCATTTA
TTCCATGGACATTTAGTTAGTGCTTTTTATATACCAGGCATGATGCTGAGTGACACTCTTGT
GTATATTTCCAAATTTTTGTACAGTCGCTGCACATATTTGAAATCATATATTAAGACTTTCC
AAAGATGAGGTCCCTGGTTTTTCATGGCAACTTGATCAGTAAGGATTTCACCTCTGTTTGTA
ACTAAAACCATCTACTATATGTTAGACATGACATTCTTTTTCTCTCCTTCCTGAAAAATAAA
GTGTGGGAAGAGACA
```

FIGURE 42

```
></usr/seqdb2/sst/DNA/Dnaseqs.min/ss.DNA125214
><subunit 1 of 1, 572 aa, 1 stop
><MW: 63953, pI: 6.55, NX(S/T): 12
MECLYYFLGFLLLAARLPLDAAKRFHDVLGNERPSAYMREHNQLNGWSSDENDWNEKLYP
VWKRGDMRWKNSWKGGRVQAVLTSDSPALVGSNITFAVNLIFPRCQKEDANGNIVYEKNC
RNEAGLSADPYVYNWTAWSEDSDGENGTGQSHHNVFPDGKPFPHHPGWRRWNFIYVFHTL
GQYFQKLGRCSVRVSVNTANVTLGPQLMEVTVYRRHGRAYVPIAQVKDVYVVTDQIPVFV
TMFQKNDRNSSDETFLKDLPIMFDVLIHDPSHFLNYSTINYKWSFGDNTGLFVSTNHTVN
HTYVLNGTFSLNLTVKAAAPGPCPPPPPPPRPSKPTPSLATTLKSYDSNTPGPTGDNPLE
LSRIPDENCQINRYGHFQATITIVEGILEVNIIQMTDVLMPVPWPESSLIDFVVTCQGSI
PTEVCTIISDPTCEITQNTVCSPVDVDEMCLLTVRRTFNGSGTYCVNLTLGDDTSLALTS
TLISVPDRDPASPLRMANSALISVGCLAIFVTVISLLVYKKHKEYNPIENSPGNVVRSKG
LSVFLNRAKAVFFPGNQEKDPLLKNQEFKGVS Important features of the protein:
    Signal peptide:
    Amino acids    1-21

Transmembrane domain:
    Amino acids    496-516

N-glycosylation sites:
    Amino acids    93-97;134-138;146-150;200-204;249-253;275-279;
                   296-300;300-304;306-310;312-316;459-463;467-471

N-myristoylation sites:
    Amino acids    91-97;147-153;290-296;418-424

Prokaryotic membrane lipoprotein lipid attachment site:
    Amino acids    496-507

Cell attachment sequence:
    Amino acids    64-67
```

FIGURE 43

```
GCATAGATGAATGTATCAGTGGATGGATAGTTGGCTAGATGGGTGGGTTGGTGGATGAATGG
CAGAGCTTGCACCTGCCAGTCCATCTGACATCAAAGCCAGTGTCTCTAATGGTGACACCACC
CTCCTCTGCAGCAGGAGGCAGAGCTGTGGGATGAATGAGGTTCGCCAGGTCTCCCTTACCTA
TCCTGGGTCCCCAGCTCCTTCTCACTCTCTTCCCTTGCAGCCTCGAAGCGGAGGATCCCTGT
GTCCCAGCCGGGCATGGCCGACCCCACCAGCTTTTCGATGACACAAGTTCAGCCCAGAGCC
GGGGCTATGGGGCCCAGCGGGCACCTGGTGGCCTGAGTTATCCTGCAGCCTCTCCCACGCCC
CATGCAGCCTTCCTGGCTGACCCGGTGTCCAACATGGCCATGGCCTATGGGAGCAGCCTGGC
CGCGCAGGGCAAGGAGCTGGTGGATAAGAACATCGACCGCTTCATCCCCATCACCAAGCTCA
AGTATTACTTTGCTGTGGACACCATGTATGTGGGCAGAAAGCTGGGCCTGCTGTTCTTCCCC
TACCTACACCAGGACTGGGAAGTGCAGTACCAACAGGACACCCCGGTGGCCCCCCGCTTTGAC
GTCAATGCCCCGGACCTCTACATTCCAGCAATGGCTTTCATCACCTACGTTTTGGTGGCTGG
TCTTGCGCTGGGGACCCAGGATAGGTTCTCCCCAGACCTCCTGGGGCTGCAAGCGAGCTCAG
CCCTGGCCTGGCTGACCCTGGAGGTGCTGGCCATCCTGCTCAGCCTCTATCTGGTCACTGTC
AACACCGACCTCACCACCATCGACCTGGTGGCCTTCTTGGGCTACAAATATGTCGGGATGAT
TGGCGGGGTCCTCATGGGCCTGCTCTTCGGGAAGATTGGCTACTACCTGGTGCTGGGCTGGT
GCTGCGTAGCCATCTTTGTGTTCATGATCCGGACGCTGCGGCTGAAGATCTTGGCAGACGCA
GCAGCTGAGGGGGTCCCGGTGCGTGGGGCCCGGAACCAGCTGCGCATGTACCTGACCATGGC
GGTGGCGGCGGCGCAGCCTATGCTCATGTACTGGCTCACCTTCCACCTGGTGCGGTGAGCGC
GCCCGCTGAACCTCCCGCTGCTGCTGCTGCTGGGGGCCACTGTGGCCGCCGAACTCATC
TCCTGCCTGCAGGCCCCAAGGTCCACCCTGTCTGGCCACAGGCACCGCCTCCATCCCATGTC
CCGCCCAGCCCCGCCCCCAACCCAAGGTGCTGAGAGATCTCCAGCTGCACAGGCCACCGCCC
CAGGGCGTGGCCGCTGTTACAGAAACAATAAACCCTGATGGGCATGGCAAAAAAAAAAAAA
AAAAAAAAAAAAAAAAAAAAAAAAAAAAAAAAAAAAAAAAAAAAAAAAAAAAAAAAAAAA
AAAAAGA
```

FIGURE 44

```
></usr/seqdb2/sst/DNA/Dnaseqs.min/ss.DNA125219
><subunit 1 of 1, 283 aa, 1 stop
><MW: 31175, pI: 7.51, NX(S/T): 0
MADPHQLFDDTSSAQSRGYGAQRAPGGLSYPAASPTPHAAFLADPVSNMAMAYGSSLAAQ
GKELVDKNIDRFIPITKLKYYFAVDTMYVGRKLGLLFFPYLHQDWEVQYQQDTPVAPRFD
VNAPDLYIPAMAFITYVLVAGLALGTQDRFSPDLLGLQASSALAWLTLEVLAILLSLYLV
TVNTDLTTIDLVAFLGYKYVGMIGGVLMGLLFGKIGYYLVLGWCCVAIFVFMIRTLRLKI
LADAAAEGVPVRGARNQLRMYLTMAVAAAQPMLMYWLTFHLVR
```

Important features of the protein:
Transmembrane domain:
Amino acids    126-142;164-179;215-233

N-myristoylation sites:
Amino acids    54-60;141-147;156-162;201-207;205-211;209-215

Amidation site:
Amino acids    89-93

FIGURE 45

GCTGAGCACCAACAGGAACTATTCCAGTGAAGAGCAAGTGCTGCCCGACCCAGGACCCTGTG
CCAGGCTGGCAGCCCTCCAGCTCCCTCCAGAGAGGAAACCTCTGTCTGGCTGAGGGTGGGAC
TAGCTGGGATGTCTCACTCCAGTTGCTCAGGTTCACCCAGGAAGCTCCTCCGTGGAGTGGCC
AGCCTGATTCTAGCCCTGTCCTCTCTGGCAGCACATGCCACACCTGCCTGGGCCTTCTGCTC
CCTGATGCTTGATGAGCCCCTGCCTCCTCAATGTTTCTCAAAGACAGACCCCCCTGAGGCCAGC
TTGAATGTGAAGACTGCTGAAGTCAGCTGGCTTCACTTGAGCTGCAGAAAAGGTGGCTGGGA
TGGCCCAGGTGCACCCAGAGGCCCCAGCCCTTTGGCTGCCTTTGGGTTGTGACTTGGGTTGT
CTCTGAGGCCCTGCCAGAGCTGGGCCTGCGGGTGGTGGGCGGTCCGACCTCGGGCAGTCAGT
GCTCCGCAGCCTCAGCACTGCATCCCAGACCCAGTGTCCTCAGAGGGAAGAGCCAGCCTCCC
TGCCTCATGGAACCAGGAGTCCCAAAAAGTCAGGAGCCTGGAGGCTCTGAAAGGAGCAGGGA
TTCCATAGTGCGTGAAGCTGAAATAGGCGCCCTCCTGGGGAGCCCCAGCAAAACTGTTTTT
CATACCCACTCCCAGAACTGCCCCGCTCCAGCTCCAGCGCCAGCGCCAGCTGGTTGCCAGGC
GTCATTGGAGAGGCCTGGCTGCCCCAGGGGCAGCAGGGAGTGGTGGACCTGTATGGGCTGGC
AGGAGGCCATTGGCCATGCTGACAAGTGTCACCTGCCTTCCTAGCCTGGAGCCACCCCTCAG
GTGGCCTGCTTGCACCTCCTATCCGGAGGTAGCCTGCCCCACCTGTAGGCAGAGGGGCTCT
TGCTTGAGGCCTGCACAGGAAGCAAGTATAGCCCCGGTGCCCCAGAGTGGGTTCCACTTAGC
CCTGGCGAGATGGCCTGTCCTGAGATCTCTGCTCCCAGACCCCACCATCTGGGGAGCACAGT
CCTTAGGCTGCCTGGTCCAGGAAGGGGGTGCGGCTCTGTCAGGAAACCTGGACTCTCAAGGC
CCACCAGCCTCTCCGTGAGTGTTAGAAATCACAGATACAGTATATACTTAATTACACTACTC
ACTACTCAAAAAAAAAAAAAAAAAA

FIGURE 46

></usr/seqdb2/sst/DNA/Dnaseqs.min/ss.DNA128309
><subunit 1 of 1, 97 aa, 1 stop
><MW: 10112, pI: 8.64, NX(S/T): 0
MSHSCSGSPRKLLRGVASLILALSSLAAHATPAWAFCSLMLDEPLPPQCFSKTDPPEAS
LNVKTAEVSWLHLSCRKGGWDGPGAPRGPSPLAAFGL Important features of the protein:
Signal peptide:
Amino acids    1-31

FIGURE 47

TTCCGGGCCCTGGCGTCTCGTCTCCTTACCCTGGGGCTACCCTTGCCCGGTCCTACTGCCCG
CGGTTAACCCGCCGCGAGCCGCCTCTCCCCTCCCCGCCCGACTCAACCCTGCCCTCCCCCGT
GCTTTGCAGACGCCGCCCGGGGGCCCAGGCGGCTGATGCGTGTGGGCCTCGCGCTGATCTTG
GTGGGCCACGTGAACCTGCTGCTGGGGGCCGTGCTGCATGGCACCGTCCTGCGGCACGTGGC
CAATCCCCGCGGCGCTGTCACGCCGGAGTACACCGTAGCCAATGTCATCTCTGTCGGCTCGG
GGCTGCTGAGCGTTTCCGTGGGACTTGTGGCCCTCCTGGCGTCCAGGAACCTTCTTCGCCCT
CCACTGCACTGGGTCCTGCTGGCACTAGCTCTGGTGAACCTGCTCTTGTCCGTTGCCTGCTC
CCTGGGCCTCCTTCTTGCTGTGTCACTCACTGTGGCCAACGGTGGCCGCCGCCTTATTGCTG
ACTGCCACCCAGGACTGCTGGATCCTCTGGTACCACTGGATGAGGGGCCGGGACATACTGAC
TGCCCCTTTGACCCCACAAGAATCTATGATACAGCCTTGGCTCTCTGGATCCCTTCTTTGCT
CATGTCTGCAGGGGAGGCTGCTCTATCTGGTTACTGCTGTGTGGCTGCACTCACTCTACGTG
GAGTTGGGCCCTGCAGGAAGGACGGACTTCAGGGGCAGCTAGAGGAAATGACAGAGCTTGAA
TCTCCTAAATGTAAAAGGCAGGAAAATGAGCAGCTACTGGATCAAAATCAAGAAATCCGGGC
ATCACAGAGAAGTTGGGTTTAGGACAGGTGCTGTTCCGAGACTCAGTCCTAAAGGGTTTTTT
TTCCCACTAAGCAAGGGCCCTGACCTCGGGATGAGATAACAAATTGTAATAAAGTAACTTC
TCTTTTCTTCTAAAAAAAAAAAAAAAAAAAAAAAAAAAAAAAAAAAAAAAAAAAA

FIGURE 48

```
></usr/seqdb2/sst/DNA/Dnaseqs.min/ss.DNA129535
><subunit 1 of 1, 222 aa, 1 stop
><MW: 23566, pI: 6.70, NX(S/T): 0
MRVGLALILVGHVNLLLGAVLHGTVLRHVANPRGAVTPEYTVANVISVGSGLLSVSVGLV
ALLASRNLLRPPLHWVLLALALVNLLLSVACSLGLLLAVSLTVANGGRRLIADCHPGLLD
PLVPLDEGPGHTDCPFDPTRIYDTALALWIPSLLMSAGEAALSGYCCVAALTLRGVGPCR
KDGLQGQLEEMTELESPKCKRQENEQLLDQNQEIRASQRSWV
```

Important features of the protein:
Signal peptide:
Amino acids     1-18

Transmembrane domain:
Amino acids     44-60;76-96

N-myristoylation sites:
Amino acids     94-100;175-181

Amidation site:
Amino acids     106-110

Prokaryotic membrane lipoprotein lipid attachment site:
Amino acids     81-92

FIGURE 49

CGTCAGTCTAGAAGGATAAGAGAAAGAAAGTTAAGCAACTACAGGAAATGGCTTTGGGAG
TTCCAATATCAGTCTATCTTTTATTCAACGCAATGACAGCACTGACCGAAGAGGCAGCCG
TGACTGTAACACCTCCAATCACAGCCCAGCAAGCTGACAACATAGAAGGACCCATAGCCT
TGAAGTTCTCACACCTTTGCCTGGAAGATCATAACAGTTACTGCATCAACGGTGCTTGTG
CATTCCACCATGAGCTAGAGAAAGCCATCTGCAGGTGTTTTACTGGTTATACTGGAGAAA
GGTGTGAGCACTTGACTTTAACTTCATATGCTGTGGATTCTTATGAAAAATACATTGCAA
TTGGGATTGGTGTTGGATTACTATTAAGTGGTTTTCTTGTTATTTTTTACTGCTATATAA
GAAAGAGGTATGAAAAGACAAAATATGAAGTCACTTCATATGCAATCGTTTGACAAATA
GTTATTCAGGCCCTATAATGTGTCAGGCACTGACATGTAAAATTTTTTTAATTAAAAAAG
AGCTGTAATCTGGCAAAAAGTTTCTATGTAATATTTTTCATGCCTTTTCTCATAAACCCA
GACGAGTGGTAAAAATTTGCCTTCAGTTGTAATAGGAGAGTTCAAACGTACAGTCTCCCT
TCAACCTATCTCTGTCTGCCCATATCAAAATTATAAATGAGGAGGACAGCAGGCCCCAAG
AAAGTAGGGACTAAGTATGTCTTGTTCAAAATTGTATATTCAGTGACTTACACTATGCCT
AGCACACAACACACACTGAGTAAATATTTGTTGAGTGAAATAAAATCAAGAAACAAGTAA
AAACTGA

FIGURE 50

```
></usr/seqdb2/sst/DNA/Dnaseqs.min/ss.DNA129549
><subunit 1 of 1, 133 aa, 1 stop
><MW: 14792, pI: 5.97, NX(S/T): 0
MALGVPISVYLLFNAMTALTEEAAVTVTPPITAQQADNIEGPIALKFSHLCLEDHNSYCI
NGACAFHHELEKAICRCFTGYTGERCEHLTLTSYAVDSYEKYIAIGIGVGLLLSGFLVIF
YCYIRKRYEKDKI
```

Important features of the protein:
Signal peptide:

1-20 (weak)

Transmembrane domain:

103-117

N-myristoylation site.
4-10;106-112;110-116

EGF-like domain cysteine pattern signature.
75-87

Integrins beta chain cysteine-rich domain proteins
66-88

FIGURE 51

GGCTCGAGCTTGGCTCTCAGACCATCCTGGTGGAAGAAACACTAGCAGTCTGCCCAATCTGA
ATGCAAATCCAGAATAATCTTTTCTTTTGTTGTTACACAGTTATGAGTGCAATTTTTAAATG
GCTGCTACTCTACAGCCTGCCTGCCTTATGCTTTCTCCTGGGCACGCAGGAAAGTGAGAGCT
TCCACTCCAAAGCAGAGATCCTAGTGACACTAAGTCAGGTAATAATCTCTCCAGCTGGACCT
CATGCACTCACATGGACAACACACTTCTCTCCTTCAGTGATCATCATCCTTGTACCATGTTG
GTGGCATGCTGTAATCGTGACTCAACATCCGGTTGCCAATTGCTATGTAACAAACCACCTCA
ACATTCAGTGGCTTGAATTGAAAGCAGGGTCTTGAAGAGATATTTGCACATTTCATCCTCCC
AGCAGCATTATTCACAACAGCCAATAGGCAGAAGCAACCCAATGTCCAACCATAGATGAGTG
GATAACCAAAATGTAGTCCATCCATACAATGAAATATGATTCAGCCTTAACAAGGAAGGAAG
TCCCGCCACGTGCTACAACATGGATGGACCTTGAGGACACTATGCTAAGTGAAGTAAGCCAG
GCACAAAAGGACAAATACTCTATGATTCCATTTTATAGGGTACCAAAGAGAATCAAACTCAC
AGAGATAGAAAGTAGACTGGGGTGGCCAGGGACTCGGGGAGAGAGGAAAGGGCAGTTATTGT
TTAAAAGGTACAGAGTTTCAGTTTGGGAAGATGAAAATGTTCTGGAAACGGTTAATGGTGAT
TTTACATTGTTTATGTTACCACGATTTGTAAAAGAGCAGCTGCGCTGAGAATGAGCATGCTT
GTCATTGGCAGCTCTCTGAGATTTTCAGTGCCTCTTACTGGCTTGTTAAGAAGACGGCAAAA
AAAAAAAAAAAAAAAAAAAAAAAAAAAAAAAAAAAAAAAAAAAAA

FIGURE 52

></usr/seqdb2/sst/DNA/Dnaseqs.min/ss.DNA129580
><subunit 1 of 1, 114 aa, 1 stop
><MW: 12886, pI: 7.04, NX(S/T): 0
MQIQNNLFFCCYTVMSAIFKWLLLYSLPALCFLLGTQESESFHSKAEILVTLSQVIISPA
GPHALTWTTHFSPSVIIILVPCWWHAVIVTQHPVANCYVTNHLNIQWLELKAGS Important features of the protein:
Signal peptide:
Amino acids    1-33

Transmembrane domain:
Amino acids    71-86

N-myristoylation site:
Amino acids    35-41

FIGURE 53

```
TTTTGAAATGGTTTATGACCTCTTCCCCACTTCCCCGCTTGCTTTGCTCATTAGTGTTCCTA
GGTGGCTGCTGGGTGACGGGCTTTTCATCATCTCTGATGTGGGCCAGTGCGAAAGAGCAGCT
GCAACATCTGTTTCTAATTGGGTCGTGCCTTTATAAATACTTCTTGCCTATTTGTCACATTG
CTTCCCTCCCACCCTGTCTTCCTTGGAGTACTGCAGAATCTGTAAGCGTCCCTGGAATGCAC
ACGTGGACCTTGTCATTCCCAAACAGACTTTCTGCTGGTCAGCACTTTGTAATGTTCGGCTG
TTACAGGCATTAGTCACTTGTGCTCAGAGAGAGACTGTGGTCTTTGGAAACTGAAGAAAATGTC
TTTTTTGTTGTTGTTAATTCTTGGCATCCAGTTAGATTTAACTTCTCAAGAGTTTACACAGA
CTTTTAGAAAAACATTCTGTCTCTAAGAAAAAAGTGCTCTAGCTTTGTACAGTTTTTGGATT
TTCACACTTGGTGGTTGTTTGCTGAAATGCTGTTTTGCTAGTGATTCCCCTCCTCCCCCTAT
CTGGGGTTGTAAGCAGCTCTGGGCTCTGTTCACTTCGGATACCTGTTTCTGGGGACTGCTT
TTCAACAGCGTTTTTCCTAAGGGCATATGAGAAATTTAATTTCTGATGGAATGAAGGTGAAA
CTCTAGTCCCAGGTAAACCTGGGTAGGCTGTAGAGACAGAAAGGGGGCTGCAGGTCTAGGTG
GAAGAACGAGAACGAATGCAGCATGGTATTTCCAGGCCTTTTAGATTCGGCTTCATCCACAA
CCAATGTGAGTTCTTATCTGCAAAGCGGGCCTAAGTGTAATGGAGGGAAGGTGGGCCAGGCA
CCAGGGTCCTGGGTTCTCCCGCGCCTCACTCTGTCTCCACCTGGCCCATGCATAAAGAACAC
TAGTCAAGTAGCCATTGTACCTGTTTCCTTATCTGAAAATGAGAAGGTTGGAGAGTATGACT
TCTGTTGAAACAACAAGGCGCTTACAAATTTTGGTGAAGTCGAATGAGGGCAGCGTTAAGAG
AAATATCAAAGTTAGTCATTGGATTTCAGGGCTTAGGGATGGAAACCAGCTGGTAGTAGACT
GGTTGTAGTTATGTCCAAAGGGCAGAGTGGGAAAAATTTGGCCGAAAAGAGTGTGGTGGGTG
ACCAGCAAATGTTAGAGGTATACATCAGGGCACAGAGGAGAAAAGCTAACATGATACTGATG
ACTTCAAGTCTTCACTGTCCAATTCAGAGGATAGGGGAGGGTTTAAGCTGATTAAACAGTGG
GCTTTTTTTCTCCTGCAAGAGGGTGGAGGTCTATAACTGTGCAGATTTTATCAGATGCATGC
TAATACATGTTATTCTGGGGGACTCTCTTATACCTTGAAGTAGACATTGCTGCTATTTGCGT
GAAAAAAATAGGAGGACTTATTTGAATTGAGAATGGGGATAGGCTGAGTTCCACCGAGATGT
TGGCTTAGAGATGCCTGGGCCATGCTGTACAGTAGGAAGCCCAGCAGAGGAGATTGGGCTGT
GTGGGTCATGACAAAGGGAGTTGTTAGCTTATGGTTGGCTATTAAAGTCATGGGCAAGGATG
GGCAAGAAAAGTGTGTAAAATGAGCTGACAAAAGATAAATATGTTAATTA
```

FIGURE 54

></usr/seqdb2/sst/DNA/Dnaseqs.min/ss.DNA129794
><subunit 1 of 1, 102 aa, 1 stop
><MW: 11382, pI: 8.72, NX(S/T): 0
MTSSPLPRLLCSLVFLGGCWVTGFSSSLMWASAKEQLQHLFLIGSCLYKYFLPICHIASL
PPCLPWSTAESVSVPGMHTWTLSFPNRLSAGQHFVMFGCYRH

Important features of the protein:
Signal peptide:
Amino acids     1-21

N-myristoylation site:
Amino acids     18-24

Prokaryotic membrane lipoprotein lipid attachment sites:
Amino acids     9-20; 36-47;
       89-100

FIGURE 55

ACACTGGCCAAACACTCGCATCCCAGGGCGTCTCCGGCTGCTCCCATTGAGCTGTCTGCTCG
CTGTGCCCGCTGTGCCTGCTGTGCCCGCGCTGTCGCCGCTGCTACCGCGTCTGCTGGACGCG
GGAGACGCCAGCGAGCTGGTGATTGGAGCCCTGCGGAGAGCTCAAGCGCCCAGCTCTGCCCG
AGGAGCCCAGGCTGCCCCGTGAGTCCCATAGTTGCTGCAGGAGTGGAGCCATGAGCTGCGTC
CTGGGTGGTGTCATCCCCTTGGGGCTGCTGTTCCTGGTCTGCGGATCCCAAGGCTACCTCCT
GCCCAACGTCACTCTCTTAGAGGAGCTGCTCAGCAAATACCAGCACAACGAGTCTCACTCCC
GGGTCCGCAGAGCCATCCCCAGGGAGGACAAGGAGGAGATCCTCATGCTGCACAACAAGCTT
CGGGGCCAGGTGCAGCCTCAGGCCTCCAACATGGAGTACATGACCTGGGATGACGAACTGGA
GAAGTCTGCTGCAGCGTGGGCCAGTCAGTGCATCTGGGAGCACGGGCCCACCAGTCTGCTGG
TGTCCATCGGGCAGAACCTGGGCGCTCACTGGGGCAGGTATCGCTCTCCGGGGTTCCATGTG
CAGTCCTGGTATGACGAGGTGAAGGACTACACCTACCCCTACCCGAGCGAGTGCAACCCCTG
GTGTCCAGAGAGGTGCTCGGGGCCTATGTGCACGCACTACACACAGATAGTTTGGGCCACCA
CCAACAAGATCGGTTGTGCTGTGAACACCTGCCGGAAGATGACTGTCTGGGGAGAAGTTTGG
GAGAACGCGGTCTACTTTGTCTGCAATTATTCTCCAAAGGGGAACTGGATTGGAGAAGCCCC
CTACAAGAATGGCCGGCCCTGCTCTGAGTGCCCACCCAGCTATGGAGGCAGCTGCAGGAACA
ACTTGTGTTACCGAGAAGAAACCTACACTCCAAAACCTGAAACGGACGAGATGAATGAGGTG
GAAACGGCTCCCATTCCTGAAGAAAACCATGTTTGGCTCCAACCGAGGGTGATGAGACCCAC
CAAGCCCAAGAAAACCTCTGCGGTCAACTACATGACCCAAGTCGTCAGATGTGACACCAAGA
TGAAGGACAGGTGCAAAGGGTCCACGTGTAACAGGTACCAGTGCCCAGCAGGCTGCCTGAAC
CACAAGGCGAAGATCTTTGGAAGTCTGTTCTATGAAAGCTCGTCTAGCATATGCCGCGCCGC
CATCCACTACGGGATCCTGGATGACAAGGGAGGCCTGGTGGATATCACCAGGAACGGGAAGG
TCCCCTTCTTCGTGAAGTCTGAGAGACACGGCGTGCAGTCCCTCAGCAAATACAAACCTTCC
AGCTCATTCATGGTGTCAAAAGTGAAAGTGCAGGATTTGGACTGCTACACGACCGTTGCTCA
GCTGTGCCCGTTTGAAAAGCCAGCAACTCACTGCCCAAGAATCCATTGTCCGGCACACTGCA
AAGACGAACCTTCCTACTGGGCTCCGGTGTTTGGAACCAACATCTATGCAGATACCTCAAGC
ATCTGCAAGACAGCTGTGCACGCGGGAGTCATCAGCAACGAGAGTGGGGGTGACGTGGACGT
GATGCCCGTGGATAAAAAGAAGACCTACGTGGGCTCGCTCAGGAATGGAGTTCAGTCTGAAA
GCCTGGGGACTCCTCGGGATGGAAAGGCCTTCCGGATCTTTGCTGTCAGGCAGTGAATTTCC
AGCACCAGGGGAGAAGGGGCGTCTTCAGGAGGGCTTCGGGGTTTTGCTTTTATTTTTATTTT
GTCATTGCGGGTATATGGAGAGTCA

FIGURE 56

```
></usr/seqdb2/sst/DNA/Dnaseqs.min/ss.DNA131590
><subunit 1 of 1, 497 aa, 1 stop
><MW: 55906, pI: 8.43, NX(S/T): 4
MSCVLGGVIPLGLLFLVCGSQGYLLPNVTLLEELLSKYQHNESHSRVRRAIPREDKEEIL
MLHNKLRGQVQPQASNMEYMTWDDELEKSAAAWASQCIWEHGPTSLLVSIGQNLGAHWGR
YRSPGFHVQSWYDEVKDYTYPYPSECNPWCPERCSGPMCTHYTQIVWATTNKIGCAVNTC
RKMTVWGEVWENAVYFVCNYSPKGNWIGEAPYKNGRPCSECPPSYGGSCRNNLCYREETY
TPKPETDEMNEVETAPIPEENHVWLQPRVMRPTKPKKTSAVNYMTQVVRCDTKMKDRCKG
STCNRYQCPAGCLNHKAKIFGSLFYESSSSICRAAIHYGILDDKGGLVDITRNGKVPFFV
KSERHGVQSLSKYKPSSSFMVSKVKVQDLDCYTTVAQLCPFEKPATHCPRIHCPAHCKDE
PSYWAPVFGTNIYADTSSICKTAVHAGVISNESGGDVDVMPVDKKKTYVGSLRNGVQSES
LGTPRDGKAFRIFAVRQ
```

Important features of the protein:
Signal peptide:
Amino acids    1-22

N-glycosylation sites:
Amino acids    27-31;41-45;451-455 cAMP- and cGMP-dependent protein kinase phosphorylation sites:
Amino acids    181-185;276-280;464-468

Tyrosine kinase phosphorylation site:
Amino acids    385-393

N-myristoylation sites:
Amino acids    111-117;115-121;174-180;204-210;227-233;300-306;
               447-453;470-476

Extracellular proteins SCP/Tpx-1/Ag5/PR-1/Sc7 signature 2:
Amino acids    195-207

SCP-like extracellular protein:
Amino acids    56-208

FIGURE 57

GCACGAGGCCAAACACAGCAGCCTCAACATGAAGGTGGTTATGGTCCTCCTGCTTGCTGCCC
TCCCCCTTTACTGCTATGCAGGTTCTGGTTGCGTTCTTCTGGAGAGCGTCGTGGAAAAGACC
ATCGATCCATCGGTTTCTGTGGAGGAATACAAAGCAGATCTTCAGAGGTTCATCGACACTGA
GCAAACCGAAGCAGCTGTAGAGGAGTTCAAGGAGTGCTTCCTCAGCCAGAGCAATGAGACTC
TGGCCAACTTCCGAGTCATGGTGCATACGATATATGACAGCCTTTACTGTGCTGCGTATTAA
CTGTCACAAGAACTTTGGCTCAGAGGAATCCAGACGATGCTCACAACCCGACTGTGGACTGG
CAGAAATCTCAACTTTTCCTTTTGACTTTCCCCTTTGATCAGTAATATGGAAGACGTTGTTG
AAACCTGAAGTATAGTTAATTTAAATAAACCCACTGCAAGAAAAAAAAAAA

FIGURE 58

```
></usr/seqdb2/sst/DNA/Dnaseqs.min/ss.DNA135173
><subunit 1 of 1, 93 aa, 1 stop
><MW: 10456, pI: 4.37, NX(S/T): 1
MKVVMVLLLAALPLYCYAGSGCVLLESVVEKTIDPSVSVEEYKADLQRFIDTEQTEAAVE
EFKECFLSQSNETLANFRVMVHTIYDSLYCAAY
```

Important features of the protein:
Signal peptide:
Amino acids    1-18

Prokaryotic membrane lipoprotein lipid attachment site:
Amino acids    12-23

FIGURE 59A

CAAGTCCGTTGAGGCTGCCAGGCGAGTCAGGTCTCTCTGGACCTCGCCTGACTCGGCTGGGC
TGTGCCTGAAATTGACCCAGCTCCACCATACTCCTTGATTATGAGAAAACAAGGAGTAAGCT
CAAAGCGGCTGCAATCTTCCGGCCGCAGCCAGTCTAAGGGGCGGCGCGGGGCCTCCCTCGCC
CGGGAGCCGGAGGTAGAGGAGGAGGTGGAAAAGTCGGTCCTAGGCGGCGGGAAACTGCCAAG
GGGCGCCTGGAGGTCCTCCCCGGGGAGGATCCAAAGTCTGAAAGAGCGAAAAGGCTTGGAGC
TAGAGGTGGTGGCCAAGACCTTTCTTCTCGGCCCCTTCCAGTTCGTCCGTAATTCCCTGGCG
CAGCTCCGGGAAAAGGTGCAGGAACTGCAGGCGCGGCGGTTCTCCAGCAGAACCACTCTCGG
CATCGCTGTCTTTGTGGCAATTTTACATTGGTTACATTTAGTAACACTTTTTGAAAATGATC
GTCATTTCTCTCACCTCTCATCTTTGGAACGGGAGATGACTTTTCGCACTGAAATGGGACTT
TATTATTCATACTTCAAGACCATTATTGAAGCACCTTCGTTTTTGGAAGGACTGTGGATGAT
TATGAATGACAGGCTTACTGAATATCCTCTTATAATTAATGCAATAAAACGCTTCCATCTTT
ATCCAGAGGTAATCATAGCCTCCTGGTATTGCACATTCATGGGAATAATGAATTTATTTGGA
CTAGAAACTAAGACCTGCTGGAATGTCACCAGAATAGAACCTCTTAATGAAGTTCAAAGCTG
TGAAGGATTGGGAGATCCTGCTTGCTTTTATGTTGGTGTAATCTTTATTTTAAATGGACTAA
TGATGGGATTGTTCTTCATGTATGGAGCATACCTGAGTGGGACTCAACTGGGAGGTCTTATT
ACAGTACTGTGCTTCTTTTTCAACCATGGAGAGGCCACCCGTGTGATGTGGACACCACCTCT
CCGTGAAAGTTTTTCCTATCCTTTCCTTGTACTTCAGATGTGTATTTTAACTTTGATTCTCA
GGACCTCAAGCAATGATAGAAGGCCCTTCATTGCACTCTGTCTTTCCAATGTTGCTTTTATG
CTTCCCTGGCAATTTGCTCAGTTTATACTTTTTACACAGATAGCATCATTATTTCCCATGTA
TGTTGTGGGATACATTGAACCAAGCAAATTTCAGAAGATCATTTATATGAACATGATTTCAGTT
ACCCTTAGTTTCATTTTGATGTTTGGAAATTCAATGTACTTATCTTCTTATTATTCTTCATC
TTTGTTAATGACGTGGGCAATAATTCTAAAGAGAAATGAAATTCAAAAACTGGGAGTATCTA
AACTCAACTTTTGGCTAATTCAAGGTAGTGCCTGGTGGTGTGGAACAATCATTTTGAAATTT
CTGACATCTAAAATCTTAGGCGTTTCAGACCACATTCGCCTGAGTGATCTTATAGCAGCCAG
AATCTTAAGGTATACAGATTTTGATACTTTAATATATACCTGTGCTCCCGAATTTGACTTCA
TGGAAAAAGCGACTCCGCTGAGATACACAAAGACATTATTGCTTCCAGTTGTTATGGTGATT
ACATGTTTTATCTTTAAAAGACTGTTCGTGATATTTCATATGTTTTAGCTACAAACATTTA
TCTAAGAAAACAGCTCCTTGAACACAGTGAGCTGGCTTTTCACACATTGCAGTTGTTAGTGT
TTACTGCCCTTGCCATTTTAATTATGAGGCTAAAGATGTTTTTGACACCGCACATGTGTGTT
ATGGCTTCCTTGATATGCTCTCGACAGCTCTTTGGCTGGCTTTTTCGCAGAGTTCGTTTTGA
GAAGGTTATCTTTGGCATTTTAACAGTGATGTCAATACAAGGTTATGCAAACCTCCGTAATC
AATGGAGCATAATAGGAGAATTTAATAATTTGCCTCAGGAAGAACTTTTACAGTGGATCAAA
TACAGTACCACATCAGATGCTGTCTTTGCAGGTGCCATGCCTACAATGGCAAGCATCAAGCT
GTCTACACTTCATCCCATTGTGAATCATCCACATTACGAAGATGCAGACTTGAGGGCTCGGA
CAAAAATAGTTTATTCTACATATAGTCGAAATCTGCCAAAGAAGTAAGAGATAAATTGTTG
GAGTTACATGTGAATTATTATGTTTAGAAGAGGCATGGTGTTGTGAGAACTAAGCCTGG
TTGCAGTATGCTTGAAATCTGGGATGTGGAAGACCCTTCCAATGCAGCTAACCCTCCCTTAT
GTAGCGTCCTGCTCGAAGACGCCAGGCCTTACTTCACCACAGTATTTCAGAATAGTGTGTAC
AGAGTATTAAAGGTTAACTGAGAAGGATACTACCCATTTTACTATGGCACAATGCCGTGTGT
CAAAAACAATCACCCTTTGGCTTATTCACATTAATAAAAATCACAAGCTTTAATAACAGACA
CTTAAAAATAAGATAAAAATGGATTGGAAATTTTTCTGATTACTAAAAGGTAAATTACTTTT
CTGTTCATTGAATGTCAGCCTTATTAAGCTTGTCATATAAGTTATTAAATCATTCATGTCAT
ACTGCATAAACAAATGTTCATTTCAGAATTTTAAAGAGAAATGTATATAAAGAACMATGATT
TTAATAATCAGGGGTATGTAAGTCCTTTTTCATCCAACTAGGTGAATTGCTTCAGATTTTCT
CTAGTACCAGAGGGTACCTCCTCAAACTCTTTGAACCACTTAAGGCAGAAGAATGCAAGCTC
TGAAATGACATCCTTAAAATGCTGATACTGGTCACAGCCTCTTTACCTCTGTGAGGAAATTG
TAACAGTGTGTCTTTTAAGGTGTTTTTATTTTACCAGCCCTTAAGAAAGATCTCTAATACCT
TTTAATACTTTTTTTTAATAATTTCAAGTTGAAGTGTTTTAAAAACACTTTGTTTTGTAAT
GTTTTGAATCTCTTGAGATGTGTTTACCCCACTAGATACATATTTGCCACTGGTTAGTTCTC
CATCTAAGCTCAAGAGGTTATTCATCTCTCTTTAGATTCCAGTGGCTTTTCTTTTAACATCC
AGGTAAAACAGAAACTGCTATGGTATACAACCAAGTTTTGGGGTTAAACATAATCAGAAAAG

FIGURE 59B

```
AAAATCCAGTTAAATTTATGAAGTGAGATTTTCAGATCCTAGATCTTGAATAAAGGAAAGGT
CTTTTCATCTTGATGGCCCCAAAGCTTGTTGGTCATGGTCTTTATTTCTGGCCACTATCTTC
TTAAATAATATATTTTTAAGCCCTCATTTATTTTTGGTTTTGGGTGAGGAAAGTCATGTTTT
CTAAGTCCTCTCCCCTAATAAAACCTACCCAACAATAGTGCTTTGAAAAGTGGTAGTTATCT
TGAAGATACTCTTGCCAAATGCAAAGATAAACATTCTTTTTGTCTGCTTTATAAATATGAAA
TATGCCAGATCTATAGTATTTTAATGTGCATCTACTTTAAATGAGTCATCTTGGGGTTTTTA
TAATTCCCTTATGTTCTTGCCCCTCTACACTTGAAATAACAAAATGCCTTAATTTTATGGAT
TAGTTCTCTTATAGTAGACAGGCAGCTATATGCAGCAAAACCAATAAAGTTATTTTTCAACT
TTCATAGTTGTAAAATATCTTATACCAGAATACAAAACAGCTAAGAAAACATGCCACATTTAT
TTTAGCATTTTCAAATAATTTGTTTTTGGTGTAAGCACAGGATAAAAAAGGAGAGCGTCAAA
GAAAAGAGACATAACACCTAACATTCATAAAAATTAACAAAGTATATTTTGGATGATGTTTT
TACAGGAAATATTTTAAATAAGTTGGTAGAACTTTTAAAATGGTACTGTATTAGCTAATAAA
ATATTCAGTACAAATATATGTTTGGATTTATGCATTAAAAAACTAATAAAATTATTTCCAAC
TTTA
```

FIGURE 60

```
></usr/seqdb2/sst/DNA/Dnaseqs.min/ss.DNA138039
><subunit 1 of 1, 758 aa, 1 stop
><MW: 87354, pI: 9.36, NX(S/T): 1
MRKQGVSSKRLQSSGRSQSKGRRGASLAREPEVEEEVEKSVLGGGKLPRGAWRSSPGRIQ
SLKERKGLELEVVAKTFLLGPFQFVRNSLAQLREKVQELQARRFSSRTTLGIAVFVAILH
WLHLVTLFENDRHFSHLSSLEREMTFRTEMGLYYSYFKTIIEAPSFLEGLWMIMNDRLTE
YPLIINAIKRFHLYPEVIIASWYCTFMGIMNLFGLETKTCWNVTRIEPLNEVQSCEGLGD
PACFYVGVIFILNGLMMGLFFMYGAYLSGTQLGGLITVLCFFFNHGEATRVMWTPPLRES
FSYPFLVLQMCILTLILRTSSNDRRPFIALCLSNVAFMLPWQFAQFILFTQIASLFPMYV
VGYIEPSKFQKIIYMNMISVTLSFILMFGNSMYLSSYYSSSLLMTWAIILKRNEIQKLGV
SKLNFWLIQGSAWWCGTIILKFLTSKILGVSDHIRLSDLIAARILRYTDFDTLIYTCAPE
FDFMEKATPLRYTKTLLLPVVMVITCFIFKKTVRDISYVLATNIYLRKQLLEHSELAFHT
LQLLVFTALAILIMRLKMFLTPHMCVMASLICSRQLFGWLFRRVRFEKVIFGILTVMSIQ
GYANLRNQWSIIGEFNNLPQEELLQWIKYSTTSDAVFAGAMPTMASIKLSTLHPIVNHPH
YEDADLRARTKIVYSTYSRKSAKEVRDKLLELHVNYYVLEEAWCVVRTKPGCSMLEIWDV
EDPSNAANPPLCSVLLEDARPYFTTVFQNSVYRVLKVN
```

Important features of the protein:
Transmembrane domain:
Amino acids  109-124;197-213;241-260;266-283;302-315;336-356;
             376-391;430-450;495-509;541-560;584-599;634-647

N-glycosylation site:
Amino acids  222-226 cAMP- and cGMP-dependent protein kinase phosphorylation site:
Amino acids  102-106

Tyrosine kinase phosphorylation site:
Amino acids  511-519

N-myristoylation sites:
Amino acids  24-30;50-56;151-157;254-260;264-270;269-275;
             273-279;639-645

Amidation site:
Amino acids  20-24

FIGURE 61

GGCGCGGCCACATCCTTTAAATATGGTCTTTCTTGGGCGCGCGCGACAATGTGAGGAGTGGG
GTGGAGCGTGTGTGGTGTGTGGCTGCGGCCTGGGCAAGAGCCGCCGCGGACCATGAGCTGAG
TAAGTTCTGGAGGGATCCTGCCTCTTGGAGCCTTCGCAGCCAGGCAGCTGTGAACTGTGAGC
TAGAGTGAAGCAGAAATCTAGGAAGATGAGCTCCAAGATGGTCATAAGTGAACCAGGACTGA
ATTGGGATATTTCCCCCAAAAATGGCCTTAAGACATTTTTCTCTCGAGAAAATTATAAAGAT
CATTCCATGGCTCCAAGTTTAAAAGAACTACGTGTTTTATCCAACAGACGTATAGGAGAAAA
TTTGAATGCCTCAGCAAGTTCTGTAGAAAATGAGCCGGCAGTTAGTTCAGCAACTCAAGCAA
AGGAAAAGTTAAAACCACAATTGGAATGGTTCTTCTTCCAAAACCAAGAGTTCCTTATCCT
CGTTTCTCTCGTTTCTCACAGAGAGAGCAGAGGAGTTATGTGGACTTGTTGGTTAAATACGC
AAAGATTCCTGCAAATTCCAAAGCTGTTGGAATAAATAAAAATGACTACTTGCAGTACTTGG
ATATGAAAAAACATGTGAACGAAGAAGTTACTGAGTTCCTAAAGTTTTTGCAGAATTCTGCA
AAGAAATGTGCGCAGGATTATAATATGCTTTCTGATGATGCCCGTCTCTTCACAGAGAAAAT
TTTAAGAGCTTGCATTGAACAAGTGAAAAGTATTCAGAATTCTATACTCTCCACGAGGTCA
CCAGCTTAATGGGATTCTTCCCATTCAGAGTAGAGATGGGATTAAAGTTAGAAAAAACTCTT
CTCGCATTGGGCAGTGTAAAATATGTGAAAACAGTATTTCCCTCAATGCCTATAAAGTTGCAG
CTGTCAAAGGACGATATAGCTACCATTGAAACGTCAGAACAAACAGCTGAAGCTATGCATTA
TGATATTAGTAAAGATCCAAATGCAGAGAAGCTTGTTTCCAGATATCACCCTCAGATAGCTC
TAACTAGTCAGTCATTATTTACCTTATTAAATAATCATGGACCAACGTACAAGGAACAGTGG
GAAATTCCAGTGTGTATTCAAGTAATACCTGTTGCAGGTTCAAAACCAGTTAAAGTAATATA
TATTAATTCACCACTTCCCCAAAAGAAAATGACTATGAGAGAGAGAAATCAAATCTTTCATG
AAGTTCCATTAAAATTTATGATGTCCAAAACACATCTGTTCCAGTCTCTGCAGTCTTTATG
GACAAACCTGAAGAGTTTATATCTGAAATGGACATGTCCTGTGAAGTCAACGAGTGCCGAAA
AATTGAGAGTCTTGAAAACTTGTATTTGGATTTTGATGATGATGTCACAGAACTTGAAACTT
TTGGAGTAACCACCACCAAAGTATCAAAATCACCAAGTCCAGCAAGTACTTCCACAGTACCT
AACATGACAGATGCTCCTACAGCCCCCAAAGCAGGAACTACAACTGTGGCACCAAGTGCACC
AGACATTTCTGCTAATTCTAGAAGTTTATCTCAGATTCTGATGGAACAATTGCAAAAGGAGA
AACAGCTGGTCACTGGTATGGATGGTGGCCCTGAGGAATGCAAAAATAAAGATGATCAGGGA
TTTGAATCATGTGAAAAGGTATCAAATTCTGACAAGCCTTTGATACAAGATAGTGACTTGAA
AACATCTGATGCCTTACAGTTAGAAAATTCTCAGGAAATTGAAACTTCTAATAAAAATGATA
TGACTATAGATATACTACATGCTGATGGTGAAAGACCTAATGTTCTAGAAAACCTAGACAAC
TCAAAGGAAAAGACTGTTGGATCAGAAGCAGCAAAAACTGAAGATACAGTTCTCTGCAGCAG
TGATACAGATGAGGAGTGTTTAATCATTGATACAGAATGTAAAAAAACCAGTTATAACAGTG
TTTAATTTAGATAAGTTTGAGGGAAAATAATCAGTAGGCAAGAGGAACATTTTTCCTGTAGT
AGCTAGAGTGCCTTGAAAAAATGTGTTGGCTATGTGAAGGAATATTTCAACTAAAATGGAAT
GGTATGCTTTTCACCCTTAAAGTTTGAGGAGGATCTTGATATGTTTTAACATTATCATGGCA
GGGAAATATATAAAGAAGAAAAATATTTTTACATTAAACCTTTTCTAAAAATTGTAAATAGA
AAATAATTTGGTTTTTTATCAAGAACAACACTTATCGTTATGTATTGTGTTAGTTATATTG
CCAGTCTGTTGCGACTGACTCAAAAAGTTAAATGTTGCCACTGCTGAAGATGATTATGAGCA
TCGCAAACTTTGTTTCTGACCCATTTTGACAGTTTTTATATACTCCTTTAAAATGATGAATG
TTACAGGTAATAAAGTTAATACCTTTAAA

FIGURE 62

```
></usr/seqdb2/sst/DNA/Dnaseqs.min/ss.DNA139540
><subunit 1 of 1, 592 aa, 1 stop
><MW: 66453, pI: 5.42, NX(S/T): 3
MSSKMVISEPGLNWDISPKNGLKTFFSRENYKDHSMAPSLKELRVLSNRRIGENLNASAS
SVENEPAVSSATQAKEKVKTTIGMVLLPKPRVPYPRFSRFSQREQRSYVDLLVKYAKIPA
NSKAVGINKNDYLQYLDMKKHVNEEVTEFLKFLQNSAKKCAQDYNMLSDDARLFTEKILR
ACIEQVKKYSEFYTLHEVTSLMGFFPFRVEMGLKLEKTLLALGSVKYVKTVFPSMPIKLQ
LSKDDIATIETSEQTAEAMHYDISKDPNAEKLVSRYHPQIALTSQSLFTLLNNHGPTYKE
QWEIPVCIQVIPVAGSKPVKVIYINSPLPQKKMTMRERNQIFHEVPLKFMMSKNTSVPVS
AVFMDKPEEFISEMDMSCEVNECRKIESLENLYLDFDDDVTELETFGVTTTKVSKSPSPA
STSTVPNMTDAPTAPKAGTTTVAPSAPDISANSRSLSQILMEQLQKEKQLVTGMDGGPEE
CKNKDDQGFESCEKVSNSDKPLIQDSDLKTSDALQLENSQEIETSNKNDMTIDILHADGE
RPNVLENLDNSKEKTVGSEAAKTEDTVLCSSDTDEECLIIDTECKKTSYNSV Important features of the protein:
N-glycosylation sites:
Amino acids    56-60;354-358;427-431 cAMP- and cGMP-dependent protein kinase phosphorylation sites:
Amino acids    187-191;331-335;585-589

N-myristoylation sites:
Amino acids    126-132;407-413;557-563
```

FIGURE 63

TTTTTAACTTGAACTTCCAAGGCCACGTGCGTCTCCTGGCTCCTGCACGGACTGTGTGACTG
TCCCCGACAGCTTTCCTGTCTCGTCTCATGAGGGGTCCAGCACATGGCATTCTGGGTCGGCA
CCTGAAGTCCACCTCTATGAGACCCTCTGGGAGCGTGACGGGGCCTTGGCATGGGTCGGCCG
AGGCCCTTCTGTCCCAGGTCACTGGTGTGGTCGGCCCAGGCCCTCCTGTCCCACATCACCTG
TGTGGTCGGCCCAGGCCCTCCTGTCCCAGGTCACCGGTGTGGTCGGCCCAGGCCCTCCTGTC
CAGGTCCTCCTGTCCAGGTCACTGGTGTGGTCGGCCCAGGCCCTTCTGTCCAGGTCACCTG
TGTGGTCGGCCCAGGGCCCTCCTGTACCATGTCACTGTTGAGGGGCTGGCTCTGGAAGAGGG
CAGGGACTTGGCATTGGTGGGGGCAGGGTTCCAAGGTGTGGCCTGTCAGCAGGAAGGGGCAG
GTGGCATGGGTCCAGGCGGGACTCAGGGCTGGGGTGCCACTGCTGGAGACTGTCCGGAGGCC
CCTCCAGGGCACCTTGCCATTGCCATTGTCGCTCATGGCCATCTGGTCCCGTTTCAGGGAAC
AAGAGGAGGATCAGATGCTGCGGGACATGATTGAGAAGCTGGGTGACTGGGCCGGGGATGCT
GAGGGCTGGGCTGGCTGGCTGGGTGGGCCGGGGATGCTGAGTGCTGGGCTGGCTGGCTGGGT
GGACCGGGCCTCCAGCTGGGGGTGGGGGGGGGGCGGGTATCGGGTCCCCCCCTCAGCCTTGG
TGACAGGACAGGCAGGTTCACCCTGAGGGTGAGAGCTCCCTCCCGCCCCTAAGAGAGCCAGG
GGCAGCTGGTGACCGTGTGGTCATGGTGGGGACCAGCCCTCCGGGGCACCCAGTCGGGGCAG
GTTCTCACGTGGGAGGGCACAGGGCTTCCTGCAGGCTCGGAGGCCCAGGGCGGATTGTGGCC
AGTGGAAGGGAAGGATGTTTCTGGCAGGGGACTTGTGTGGGCCACGGCTGTGCGGCTGCGG
CGTTGAGCACGGCCTCACTGTCCACCTGTCCCCTAGGCCTCCAGAGGAAGAAGTCCAAGTTC
CGCTTGTCCAAGATCTGGTCACCAAAAAGCAAAGCAGCCCCTCCCAGTAGTAGCCAGTAGG
GCCGTGGGCTCGGCCCGGACCTGGCATCCGGACTTGGACTCGGGGCCATGGGCTTGGCCCGG
ACCCGGAACCCGGACTTGTACTCGGGGCCGTGGGCTCGGCCCGGACCCGGCATTCGGACTTG
GACTCGGGAAGGGCCTCCTGTCCCTACAAGGGGCATGTGGACAGCAGGGACCTGCGCTACCG
TCTGTGGTCTCAATAAAGAAACCGACCACATGGCCCCGGAAAAAAAAAAAAAAAAAAAAAAA
AAAAAAAAAAAAAAAAAAAAAACA

FIGURE 64

></usr/seqdb2/sst/DNA/Dnaseqs.min/ss.DNA139602
><subunit 1 of 1, 159 aa, 1 stop
><MW: 15900, pI: 8.07, NX(S/T): 0
MGRPRPFCPRSLVWSAQALLSHITCVVGPGPPVPGHRCGRPRPSCPGPPVQVTGVVGPGP
SVPGHLCGRPRALLYHVTVEGLALEEGRDLALVGAGFQGVACQQEGAGGMGPGGTQGWGA
TAGDCPEAPPGHLAIAIVAHGHLVPFQGTRGGSDAAGHD

Important features of the protein:
Signal peptide:
Amino acids     1-25

N-myristoylation sites:
Amino acids     109-115;113-119;119-125;148-154;151-157;152-158

FIGURE 65

GGCGACCACCGCCGCCTCCTCACCTGGCCATTGGTGCAGCCCGTTCCCGGCGGCGAGAGAAG
GCAGGCGCGCTCCTTGCGCCACGCCACACCGTCGGGCCCCCGTCGGGTCCCCCTCGGGCCGCA
ATGGTGGGCTCCGCGCGGCTGGGTCCGGCACTCTTGACCCCCTTTGTAACCACCGCGGCGGG
CACCCAGGGAGTTCGAGCAACGAAGTTGGTGACCTGCCCCGCTCCCAGGCAGTTTGCTGTTG
GGGCTTTCACGGCTGCTGGAAGGGCATGGCTGTTTGTCCCATCACTGGGCGCCAGCTTCTCA
AAGCTACGTTCACAGCAACGCAGTAGGGACTTTCGTGGCAGGCTTTTTTTAAGAGCTGAAAG
AAGGGCGGGAGGGTTTACGTCCTAGGGTGATGATTTCCTCACCAGACAGCGAAGTATCTATT
GGGAAACTCCAGGTGACCGCACCTCCTTCCGACAGTTCGCCCCGGGGCAAGTTTACCAGCTG
CGTCAGAAAGCAGGTTTGCAAAATCCTTGGAGAACGGCCTGAGCTAAGGACTGGGGTCAGGA
GGGTTTTAAACTCATTCTGATTTTCTTGCAATCATATCTCTTGAAAGTTTTTATATTTTCCC
CAATATTTTTCTGAGTTGCTATATCCAATGAAAACAATGCTGATGTAGAGGTCCACCAGCCA
ATGCTTTATTGGAAGTCAACGAATGAGACCGAGGGTGGCCCATAATCAATCTCGGCACGCGG
GAATGTGAACCTCTTCCAAGGTCTGGGCGAGTCCCTAGAGTTACGCAGATGAAGGACATTGG
CCCTCGAGAATCTCACACCAGCAAAGAAGAGCACAACGAAGCGCAAACTACTTATGATCATT
GTGGCTTTGGGCAAGTTGTTGTAGCTCCCAGCAACAATTTCTTCACCTGGAGTGCAGCAATA
AATGATACTGGTGCTGCAGGGCAGCTAATAAGCTTCTGAATAATATATGCAAAGTACTTGGC
ACCATGAGCAGAACTCAGTATACCGTCACTGAAGAAATAGCTTATTTAATGATTACACTTTT
CATATGTGCAAGTAAAAGTTTGACTTTTAGGGAGAGCCTCACCTACGGAATGTCTTTTTTAA
ATTTCTTTTTTAATTATACTTTAAGTTCTGGGATACATGTGCAGAACGTGCAGGTTTGTTAC
ACAGGTATACATGTGCCATGGTGGTTTGCAGCACCCATCAACCCTTCATCTAGGTTTTAAGC
TCCGCATGCATTAGTTATTTGTCCTAATGCTCTCCCTCCCCTTGTCCCCACCCCCCAACAG
GCCTCAGGGTGTGATGTTCCCCTCCCTGGGTCCATATGTTCTCATTGTTCAACTCCCACTTA
TGATGAGAACATGCAGTGTTTGGTTTTCTGTTCCTGTGTTAGTTTGCTGAGAATGATGGTTT
CCAGCATCATCCACGTCCCTGCAAAGGACATGAATTCATTCTTTTTATGGCTGCATGGTAT
TCCATGGTGTATATGTGCCACATTTTCTTCATCCAGTCTATCATTGATGGGCACTTGGGTTG
GTTCCAAGACTTTGTTATTGTGAACAGTGCTGCAATAAACATACGTTTGTATGTGTCAAAAA
AAAAAAAAAAAAAAAA

FIGURE 66

></usr/seqdb2/sst/DNA/Dnaseqs.min/ss.DNA139632
><subunit 1 of 1, 90 aa, 1 stop
><MW: 9586, pI: 12.18, NX(S/T): 0
MVGSARLGPALLTPFVTTAAGTQGVRATKLVTCPAPRQFAVGAFTAAGRAWLFVPSLGAS
FSKLRSQQRSRDFRGRLFLRAERRAGGFTS

Important features of the protein:
Signal peptide:
Amino acids    1-24

N-myristoylation sites:
Amino acids    24-30; 42-48; 58-64

FIGURE 67

CATGTCTAGACTGGGAGCCCTGGGTGGTGCCCGTGCCGGGCTGGGACTGTTGCTGGGTACCG
CCGCCGGCCTTGGATTCCTGTGCCTCCTTTACAGCCAGCGATGGAAACGGACCCAGCGTCAT
GGCCGCAGCCAGAGCCTGCCCAACTCCCTGGACTATACGCAGACTTCAGATCCCGGACGCCA
CGTGATGCTCCTGCGGGCTGTCCCAGGTGGGGCTGGAGATGCCTCAGTGCTGCCCAGCCTTC
CACGGGAAGGACAGGAGAAGGTGCTGGACCGCCTGGACTTTGTGCTGACCAGCCTTGTGGCG
CTGCGGCGGGAGGTGGAGGAGCTGAGAAGCAGCCTGCGAGGGCTTGCGGGGAGATTGTTGG
GGAGGTCCGATGCCACATGGAAGAGAACCAGAGAGTGGCTCGGCGGCGAAGGTTTCCGTTTG
TCCGGGAGAGGAGTGACTCCACTGGCTCCAGCTCTGTCTACTTCACGGCCTCCTCGGGAGCC
ACGTTCACAGATGCTGAGAGTGAAGGGGGTTACACAACAGCCAATGCGGAGTCTGACAATGA
GCGGGACTCTGACAAAGAAAGTGAGGACGGGGAAGATGAAGTGAGCTGTGAGACTGTGAAGA
TGGGGAGAAAGGATTCTCTTGACTTGGAGGAAGAGGCAGCTTCAGGTGCCTCCAGTGCCCTG
GAGGCTGGAGGTTCCTCAGGCTTGGAGGATGTGCTGCCCCTCCTGCAGCAGGCCGACGAGCT
GCACAGGGGTGATGAGCAAGGCAAGCGGGAGGGCTTCCAGCTGCTGCTCAACAACAAGCTGG
TGTATGGAAGCCGGCAGGACTTTCTCTGGCGCCTGGCCCGAGCCTACAGTGACATGTGTGAG
CTCACTGAGGAGGTGAGCGAGAAGAAGTCATATGCCCTAGATGGAAAAGAAGAAGCAGAGGC
TGCTCTGGAGAAGGGGGATGAGAGTGCTGACTGTCACCTGTGGTATGCGGTGCTTTGTGGTC
AGCTGGCTGAGCATGAGAGCATCCAGAGGCGCATCCAGAGTGGCTTTAGCTTCAAGGAGCAT
GTGGACAAAGCCATTGCTCTCCAGCCAGAAAACCCCATGGCTCACTTCTTCTTGGCAGGTG
GTGCTATCAGGTCTCTCACCTGAGCTGGCTAGAAAAAAAAACTGCTACAGCCTTGCTTGAAA
GCCCTCTCAGTGCCACTGTGGAAGATGCCCTCCAGAGCTTCCTAAAGGCTGAAGAACTACAG
CCAGGATTTTCCAAAGCAGGAAGGGTATATATTTCCAAGTGCTACAGAGAACTAGGGAAAAA
CTCTGAAGCTAGATGGTGGATGAAGTTGGCCCTGGAGCTGCCAGATGTCACGAAGGAGGATT
TGGCTATCCAGAAGGACCTGGAAGAACTGGAAGTCATTTTACGAGACTAACCACGTTTCACT
GGCCTTCATGACTTGATGCCACTATTTAAGGTGGGGGGGCGGGGAGGCTTTTTTCCTTAGAC
CTTGCTGAGATCAGGAAACCACACAAATCTGTCTCCTGGGTCTGACTGCTACCCACTACCAC
TCCCCATTAGTTAATTTATTCTAACCTCTAACCTAATCTAGAATTGGGGCAGTACTCATGGC
TTCCGTTTCTGTTGTTCTCTCCCTTGAGTAATCTCTTAAAAAAATCAAGATTCACACCTGCC
CCAGGATTACACATGGGTAGAGCCTGCAAGACCTGAGACCTTCCAATTGCTGGTGAGGTGGA
TGAACTTCAAAGCTATAGGAACAAAGCACATAACTTGTCACTTTAATCTTTTTCACTGACTA
ATAGGACTCAGTACATATAGTCTTAAGATCATACCTTACCTACCAAGGTAAAAGAGGGATCA
GAGTGGCCCACAGACATTGCTTTCTTATCACCTATCATGTGAATTCTACCTGTATTCCTGGG
CTGGACCACTTGATAACTTCCAGTGTCCTGGCAGCTTTTGGAATGACAGCAGTGGTATGGGG
TTTATGATGCTATAAAACAATGTCTGAAAAGTTGCCTAGAATATATTTTGTTACAAACTTGA
AATAAACCAAATTTGATGTT

FIGURE 68

```
></usr/seqdb2/sst/DNA/Dnaseqs.min/ss.DNA139686
><subunit 1 of 1, 470 aa, 1 stop
><MW: 52118, pI: 5.06, NX(S/T): 0
MSRLGALGGARAGLGLLLGTAAGLGFLCLLYSQRWKRTQRHGRSQSLPNSLDYTQTSDPG
RHVMLLRAVPGGAGDASVLPSLPREGQEKVLDRLDFVLTSLVALRREVEELRSSLRGLAG
EIVGEVRCHMEENQRVARRRRFPFVRERSDSTGSSSVYFTASSGATFTDAESEGGYTTAN
AESDNERDSDKESEDGEDEVSCETVKMGRKDSLDLEEEAASGASSALEAGGSSGLEDVLP
LLQQADELHRGDEQGKREGFQLLLNNKLVYGSRQDFLWRLARAYSDMCELTEEVSEKKSY
ALDGKEEAEAALEKGDESADCHLWYAVLCGQLAEHESIQRRIQSGFSFKEHVDKAIALQP
ENPMAHFLLGRWCYQVSHLSWLEKKTATALLESPLSATVEDALQSFLKAEELQPGFSKAG
RVYISKCYRELGKNSEARWWMKLALELPDVTKEDLAIQKDLEELEVILRD Important features of the protein:
Signal peptide:
Amino acids    1-32 cAMP- and cGMP-dependent protein kinase phosphorylation site:
Amino acids    209-213

N-myristoylation sites:
Amino acids    5-11;8-14;9-15;15-21;19-25;72-78;164-170;
               174-180;222-228;230-236

Amidation sites:
Amino acids    207-211;254-258

Cell attachment sequence:
Amino acids    250-253
```

FIGURE 69

CCCACGCGTCCGAAACACTTTAAACCTGACCAGCTAAATGGATAAACCTAGCCTGCATAGCT
TTTAAACTGGGGTCTCATACAGCACAGGAGGCCTACTTGCTTCAAGAACTGAAAATCCAGAG
GATGAATTGCTTTATCTGGGAATGGCAAAAGCCAGCACAATAAGGAATGCCAGTTTGTATGG
GGCTACTAGCTCACATGCGGGATCAGAATGGTGTGAATGACAGCCGCACTGTGTCATGAAGG
TGGTGGTGGTTTCCGCACAAGAGACCAAATAAGAAGAAAGCTGAGAGAGGGGGGAAACGTTTTT
GGATGACAAAGGATGGGTTTCCATTTAATTACGCAGCTGAAAGGCATGAGTGTGGTGCTGGT
GCTACTTCCTACACTGCTGCTTGTTATGCTCACGGGTGCTCAGAGAGCTTGCCCAAAGAACT
GCAGATGTGATGGCAAAATTGTGTACTGTGAGTCTCATGCTTTCGCAGATATCCCTGAGAAC
ATTTCTGGAGGGTCACAAGGCTTATCATTAAGGTTCAACAGCATTCAGAAGCTCAAATCCAA
TCAGTTTGCCGGCCTTAACCAGCTTATATGGCTTTATCTTGACCATAATTACATTAGCTCAGTG
GATGAAGATGCATTTCAAGGGATCCGTAGACTGAAAGAATTAATTCTAAGCTCCAACAAAAT
TACTTATCTGCACAATAAAACATTTCACCCAGTTCCCAATCTCCGCAATCTGGACCTCTCCT
ACAATAAGCTTCAGACATTGCAATCTGAACAATTTAAAGGCCTTCGGAAACTCATCATTTTG
CACTTGAGATCTAACTCACTAAAGACTGTGCCCATAAGAGTTTTTCAAGACTGTCGGAATCT
TGATTTTTTGGATTTGGGTTACAATCGTCTTCGAAGCTTGTCCCGAAATGCATTTGCTGGCC
TCTTGAAGTTAAAGGAGCTCCACCTGGAGCACAACCAGTTTTCCAAGATCAACTTTGCTCAT
TTTCCACGTCTCTTCAACCTCCGCTCAATTTACTTACAATGGAACAGGATTCGCTCCATTAG
CCAAGGTTTGACATGGACTTGGAGTTCCTTACACAACTTGGATTTATCAGGGAATGACATCC
AAGGAATTGAGCCGGGCACATTTAAATGCCTCCCCAATTTACAAAAATTGAATTTGGATTCC
AACAAGCTCACCAATATCTCACAGGAAACTGTCAATGCGTGGATATCATTAATATCCATCAC
ATTGTCTGGAAATATGTGGGAATGCAGTCGGAGCATTTGTCCTTTATTTTATTGGCTTAAGA
ATTTCAAAGGAAATAAGGAAAGCACCATGATATGTGCGGGACCTAAGCACATCCAGGGTGAA
AAGGTTAGTGATGCAGTGGAAACATATAATATCTGTTCTGAAGTCCAGGTGGTCAACACAGA
AAGATCACACCTGGTGCCCCAAACTCCCCAGAAACCTCTGATTATCCCTAGACCTACCATCT
TCAAACCTGACGTCACCCAATCCACCTTTGAAACACCAAGCCCTTCCCCAGGGTTTCAGATT
CCTGGCGCAGAGCAAGAGTATGAGCATGTTTCATTTCACAAAATTATTGCCGGGAGTGTGGC
TCTCTTTCTCTCAGTGGCCATGATCCTCTTGGTGATCTATGTGTCTTGGAACGCTACCCAG
CCAGCATGAAACAACTCCAGCAACACTCTCTTATGAAGAGGCGGCGGAAAAAGGCCAGAGAG
TCTGAAAGACAAATGAATTCCCCTTTACAGGAGTATTATGTGGACTACAAGCCTACAAACTC
TGAGACCATGGATATATCGGTTAATGGATCTGGGCCCTGCACATATACCATCTCTGGCTCCA
GGGAATGTGAGATGCCACACCACATGAAGCCCTTGCCATATTACAGCTATGACCAGCCTGTG
ATCGGGTACTGCCAGGCCCACCAGCCACTCCATGTCACCAAGGGCTATGAGACAGTGTCTCC
AGAGCAGGACGAAAGCCCCGGCCTGGAGCTGGGCCGAGACCACAGCTTCATCGCCACCATCG
CCAGGTCGGCAGCACCGGCCATCTACCTAGAGAGAATTGCAAACTAACGCTGAAGCCAACTC
CTCACTGGGGAGCTCCATGGGGGGGAGGGAGGGCCTTCATCTTAAAGGAGAATGGGTGTCCA
CAATCGCGCAATCGAGCAAGCTCATCGTTCCTGTTAAAACATTTATGGCATAGGGAAAAAAA
AAAAAAAAAAAAAA

FIGURE 70

```
></usr/seqdb2/sst/DNA/Dnaseqs.min/ss.DNA142392
><subunit 1 of 1, 590 aa, 1 stop
><MW: 67217, pI: 9.26, NX(S/T): 4
MGFHLITQLKGMSVVLVLLPTLLLVMLTGAQRACPKNCRCDGKIVYCESHAFADIPENIS
GGSQGLSLRFNSIQKLKSNQFAGLNQLIWLYLDHNYISSVDEDAFQGIRRLKELILSSNK
ITYLHNKTFHPVPNLRNLDLSYNKLQTLQSEQFKGLRKLIILHLRSNSLKTVPIRVFQDC
RNLDFLDLGYNRLRSLSRNAFAGLLKLKELHLEHNQFSKINFAHFPRLFNLRSIYLQWNR
IRSISQGLTWTWSSLHNLDLSGNDIQGIEPGTFKCLPNLQKLNLDSNKLTNISQETVNAW
ISLISITLSGNMWECSRSICPLFYWLKNFKGNKESTMICAGPKHIQGEKVSDAVETYNIC
SEVQVVNTERSHLVPQTPQKPLIIPRPTIFKPDVTQSTFETPSPSPGFQIPGAEQEYEHV
SFHKIIAGSVALFLSVAMILLVIYVSWKRYPASMKQLQQHSLMKRRRKKARESERQMNSP
LQEYYVDYKPTNSETMDISVNGSGPCTYTISGSRECEMPHHMKPLPYYSYDQPVIGYCQA
HQPLHVTKGYETVSPEQDESPGLELGRDHSFIATIARSAAPAIYLERIAN Important features of the protein:
   Signal peptide:
   Amino acids     1-30

Transmembrane domain:
   Amino acids     425-443

N-glycosylation sites:
   Amino acids     58-62;126-130;291-295;501-505

Tyrosine kinase phosphorylation site:
   Amino acids     136-143

N-myristoylation sites:
   Amino acids     29-35;61-67;247-253;267-273;271-277;331-337;
                   502-508;512-518;562-568

Glycosyl hydrolases family:
   Amino acids     310-319
```

FIGURE 71

TTCCAGTCAGAGTTAAGTTAAAACAGAAAAAGGAAGATGGCAAGAATATTGTTACTTTTCC
TCCCGGGTCTTGTGGCTGTATGTGCTGTGCATGGAATATTTATGGACCGTCTAGCTTCCAAG
AAGCTCTGTGCAGATGATGAGTGTGTCTATACTATTTCTCTGGCTAGTGCTCAAGAAGATTA
TAATGCCCCGGACTGTAGATTCATTAACGTTAAAAAAGGGCAGCAGATCTATGTGTACTCAA
AGCTGGTAAAAGAAAATGGAGCTGGAGAATTTTGGGCTGGCAGTGTTTATGGTGATGGCCAG
GACGAGATGGGAGTCGTGGGTTATTTCCCCAGGAACTTGGTCAAGGAACAGCGTGTGTACCA
GGAAGCTACCAAGGAAGTTCCCACCACGGATATTGACTTCTTCTGCGAGTAATAAATTAGTT
AAAACTGCAAATAGAAAGAAAACACCAAAAATAAAGAAAAGAGCAAAAGTGGCCAAAAAATG
CATGTCTGTAATTTTGGACTGACGT

FIGURE 72

></usr/seqdb2/sst/DNA/Dnaseqs.min/ss.DNA143076
><subunit 1 of 1, 128 aa, 1 stop
><MW: 14332, pI: 4.83, NX(S/T): 0
MARILLLFLPGLVAVCAVHGIFMDRLASKKLCADDECVYTISLASAQEDYNAPDCRFINV
KKGQQIYVYSKLVKENGAGEFWAGSVYGDGQDEMGVVGYFPRNLVKEQRVYQEATKEVPT
TDIDFFCE

Important features of the protein:
Signal peptide:
Amino acids    1-14

N-myristoylation site:
Amino acids    84-90

FIGURE 73

CTCAGATTTGCCATGGAGAAATTTTCAGTCTCGGCAATCCTGCTTCTTGTGGCCATCTCTGG
TACTCTGGCCAAAGACACCACAGTCAAATCTGGATCCAAAAAGGACCCAAAGGACTCTCGAC
CCAAACTACCCCAGACCCTGTCCAGAGGTTGGGGAGATCAGCTCATCTGGACTCAGACTTAC
GAAGAAGCCTTATACAAATCCAAGACAAGCAACAGACCCTTGATGGTCATTCATCACTTGGA
CGAATGCCCGCACAGTCAAGCTTTAAAGAAAGTGTTTGCTGAAAATAAGGAGATCCAGAAATTG
GCAGAGCAGTTTGTTCTCCTCAACTTGATCTATGAAACAACTGACAAGCACCTTTCTCCTGA
TGGCCAGTACGTCCCCAGAATTGTGTTTGTGGACCCTTCCCTGACGGTGAGGGCAGACATCA
CCGGAAGATACTCAAACCGTCTCTACGCTTATGAACCTTCTGACACAGCTCTGTTGCACGAC
AACATGAAGAAAGCTCTCAAGTTGCTGAAGACAGAGTTGTAGAGTCAACTGTACAGTGCCTC
AGGAGCCGGGAAGGCAGAAGCACTGTGGACCTGCCGATGACATTACAGTTTAATGTTACAAC
AAATGTATTTTTTAAACACCCACGTGTGGGGAAACAATATTATTATCTACTACAGACACATG
ATTTTCTAGAAAATAAAGTCTTGTGAGAACTCCAAA

FIGURE 74

></usr/seqdb2/sst/DNA/Dnaseqs.min/ss.DNA143294
><subunit 1 of 1, 175 aa, 1 stop, 1 unknown
><MW: 19888.97, pI: 9.08, NX(S/T): 0
MEKFSVSAILLLVAISGTLAKDTTVKSGSKKDPKDSRPKLPQTLSRGWGDQLIWTQTYEE
ALYKSKTSNRPLMVIHHLDECPHSQALKKVFAENKEIQKLAEQFVLLNLIYETTDKHLSP
DGQYVPRIVFVDPSLTVRADITGRYSNRLYAYEPSDTALLHDNMKKALKLLKTEL Important features of the protein:
Signal peptide:
Amino acids    1-20

FIGURE 75

```
GCCGGCGCCAGGGCAGGCGGGCGGCTGGCAGCTGTGGCGCCGACATGGCTGCGCTGGTGGAG
CCGCTGGGGCTGGAGCGGGACGTGTCCCGGGCGGTTGAGCTCCTCGAGCGGCTCCAGCGCAG
CGGGGAGCTGCCGCCGCAGAAGCTGCAGGCCCTCCAGCGAGTTCTGCAGAGCCGCTTCTGCT
CCGCTATCCGAGAGGTGTATGAGCAGCTTTATGACACGCTGGACATCACCGGCAGCGCCGAG
ATCCGAGCCCATGCCACAGCCAAGGCCACAGTGGCTGCCTTCACAGCCAGCGAGGGCCACGC
ACATCCCAGGGTAGTGGAGCTACCCAAGACGGATGAGGGCCTAGGCTTCAACATCATGGGTG
GCAAAGAGCAAAACTCGCCCATCTACATCTCCCGGGTCATCCCAGGGGGTGTGGCTGACCGC
CATGGAGGCCTCAAGCGTGGGGATCAACTGTTGTCGGTGAACGGTGTGAGCGTTGAGGGTGA
GCAGCATGAGAAGGCGGTGGAGCTGCTGAAGGCGGCCCAGGGCTCGGTGAAGCTGGTTGTCC
GTTACACACCGCGAGTGCTGGAGGAGATGGAGGCCCGGTTCGAGAAGATGCGCTCTGCCCGC
CGGCGCCAACAGCATCAGAGCTACTCGTCCTTGGAGTCTCGAGGTTGAAACCACAGATCTGG
ACGTTCACGTGCACTCTCTTCCTGTACAGTATTTATTGTTCCTGGCACTTTATTTAAAGATA
TTTGACCCTCAAAAAAAAAAAAAAAAAAAAAA
```

FIGURE 76

```
></usr/seqdb2/sst/DNA/Dnaseqs.min/ss.DNA143514
><subunit 1 of 1, 207 aa, 1 stop
><MW: 22896, pI: 8.93, NX(S/T): 0
MAALVEPLGLERDVSRAVELLERLQRSGELPPQKLQALQRVLQSRFCSAIREVYEQLYDT
LDITGSAEIRAHATAKATVAAFTASEGHAHPRVVELPKTDEGLGFNIMGGKEQNSPIYIS
RVIPGGVADRHGGLKRGDQLLSVNGVSVEGEQHEKAVELLKAAQGSVKLVVRYTPRVLEE
MEARFEKMRSARRRQQHQSYSSLESRG
```

Tyrosine kinase phosphorylation site:
Amino acids    51-59

N-myristoylation sites:
Amino acids    102-108; 133-139

Cell attachment sequence:
Amino acids    136-139

PDZ domain (Also known as DHR or GLGF):
Amino acids    93-174

FIGURE 77

```
CTGTCAGCTGAGGATCCAGCCGAAAGAGGAGCCAGGCACTCAGGCCACCTGAGTCTACTCAC
CTGGACAACTGGAATCTGGCACCAATTCTAAACCACTCAGCTTCTCCGAGCTCACACCCCGG
AGATCACCTGAGGACCCGAGCCATTGATGGACTCGGACGAGACCGGGTTCGAGCACTCAGGA
CTGTGGGTTTCTGTGCTGGCTGGTCTGCTGGGAGCCTGCCAGGCACACCCCATCCCTGACTC
CAGTCCTCTCCTGCAATTCGGGGGCCAAGTCCGGCAGCGGTACCTCTACACAGATGATGCCC
AGCAGACAGAAGCCCACCTGGAGATCAGGGAGGATGGGACGGTGGGGGGCGCTGCTGACCAG
AGCCCCGAAAGTCTCCTGCAGCTGAAAGCCTTGAAGCCGGGAGTTATTCAAATCTTGGGAGT
CAAGACATCCAGGTTCCTGTGCCAGCGGCCAGATGGGGCCCTGTATGGATCGCTCCACTTTG
ACCCTGAGGCCTGCAGCTTCCGGGAGCTGCTTCTTGAGGACGGATACAATGTTTACCAGTCC
GAAGCCCACGGCCTCCCGCTGCACCTGCCAGGGAACAAGTCCCCACACCGGGACCCTGCACC
CCGAGGACCAGCTCGCTTCCTGCCACTACCAGGCCTGCCCCCGCACTCCCGGAGCCACCCG
GAATCCTGGCCCCCAGCCCCCGATGTGGGCTCCTCGGACCCTCTGAGCATGGTGGGACCT
TCCCAGGGCCGAAGCCCCAGCTACGCTTCCTGAAGCCAGAGGCTGTTTACTATGACATCTCC
TCTTTATTTATTAGGTTATTTATCTTATTTATTTTTTATTTTTCTTACTTGAGATAATAAAGA
GTTCCAGAGGAGAAAAAAAAAAAAAAAAAAAAAAAAAAAAAAAAAAAAAAAAAAAAAAAAAA
AAAAAAG
```

FIGURE 78

```
></usr/seqdb2/sst/DNA/Dnaseqs.min/ss.DNA144841
><subunit 1 of 1, 208 aa, 1 stop
><MW: 22187, pI: 5.08, NX(S/T): 1
MDSDETGFEHSGLWVSVLAGLLGACQAHPIPDSSPLLQFGGQVRQRYLYTDDAQQTEAHL
EIREDGTVGGAADQSPESLLQLKALKPGVIQILGVKTSRFLCQRPDGALYGSLHFDPEAC
SFRELLLEDGYNVYQSEAHGLPLHLPGNKSPHRDPAPRGPARFLPLPGLPPALPEPPGIL
APQPPDVGSSDPLSMVGPSQGRSPSYAS
```

Important features of the protein:
Signal peptide:
Amino acids    1-27

N-myristoylation sites:
Amino acids    12-18;20-26;23-29;66-72;94-100;107-113;168-174

Prokaryotic membrane lipoprotein lipid attachment site:
Amino acids    15-26

HBGF/FGF family proteins:
Amino acids    57-73;80-131

FIGURE 79

```
AGTCCCAGACGGGCTTTTCCCAGAGAGCTAAAAGAGAAGGGCCAGAGAATGTCGTCCCAG
CCAGCAGGGAACCAGACCTCCCCCGGGGCCACAGAGGACTACTCCTATGGCAGCTGGTAC
ATCGATGAGCCCCAGGGGGGCGAGGAGCTCCAGCCAGAGGGGGAAGTGCCCTCCTGCCAC
ACCAGCATACCACCCGGCCTGTACCACGCCTGCCTGGCCTCGCTGTCAATCCTTGTGCTG
CTGCTCCTGGCCATGCTGGTGAGGCGCCGCCAGCTCTGGCCTGACTGTGTGCGTGGCAGG
CCCGGCCTGCCCAGCCCTGTGGATTTCTTGGCTGGGGACAGGCCCCGGGCAGTGCCTGCT
GCTGTTTTCATGGTCCTCCTGAGCTCCCTGTGTTTGCTGCTCCCCGACGAGGACGCATTG
CCCTTCCTGACTCTCGCCTCAGCACCCAGCCAAGATGGGAAAACTGAGGCTCCAAGAGG
GCCTGGAAGATACTGGGACTGTTCTATTATGCTGCCCTCTACTACCCTCTGGCTGCCTGT
GCCACGGCTGGCCACACAGCTGCACACCTGCTCGGCAGCACGCTGTCCTGGGCCCACCTT
GGGGTCCAGGTCTGGCAGAGGGCAGAGTGTCCCCAGGTGCCCAAGATCTACAAGTACTAC
TCCCTGCTGGCCTCCCTGCCTCTCCTGCTGGGCCTCGGATTCCTGAGCCTTTGGTACCCT
GTGCAGCTGGTGAGAAGCTTCAGCCGTAGGACAGGAGCAGGCTCCAAGGGGCTGCAGAGC
AGCTACTCTGAGGAATATCTGAGGAACCTCCTTTGCAGGAAGAAGCTGGGAAGCAGCTAC
CACACCTCCAAGCATGGCTTCCTGTCCTGGGCCCGCGTCTGCTTGAGACACTGCATCTAC
ACTCCACAGCCAGGATTCCATCTCCCGCTGAAGCTGGTGCTTTCAGCTACACTGACAGGG
ACGGCCATTTACCAGGTGGCCCTGCTGCTGCTGGTGGGCGTGGTACCCACTATCCAGAAG
GTGAGGGCAGGGGTCACCACGGATGTCTCCTACCTGCTGGCCGGCTTTGGAATCGTGCTC
TCCGAGGACAAGCAGGAGGTGGTGGAGCTGGTGAAGCACCATCTGTGGGCTCTGGAAGTG
TGCTACATCTCAGCCTTGGTCTTGTCCTGCTTACTCACCTTCCTGGTCCTGATGCGCTCA
CTGGTGACACACAGGACCAACCTTCGAGCTCTGCACCGAGGAGCTGCCCTGGACTTGAGT
CCCTTGCATCGGAGTCCCCATCCCTCCCGCCAAGCCATATTCTGTTGGATGAGCTTCAGT
GCCTACCAGACAGCCTTTATCTGCCTTGGGCTCCTGGTGCAGCAGATCATCTTCTTCCTG
GGAACCACGGCCCTGGCCTTCCTGGTGCTCATGCCTGTGCTCCATGGCAGGAACCTCCTG
CTCTTCCGTTCCCTGGAGTCCTCGTGGCCCTTCTGGCTGACTTTGGCCCTGGCTGTGATC
CTGCAGAACATGGCAGCCCATTGGGTCTTCCTGGAGACTCATGATGGACACCCACAGCTG
ACCAACCGGCGAGTGCTCTATGCAGCCACCTTTCTTCTCTTCCCCCTCAATGTGCTGGTG
GGTGCCATGGTGGCCACCTGGCGAGTGCTCCTCTCTGCCCTCTACAACGCCATCCACCTT
GGCCAGATGGACCTCAGCCTGCTGCCACCGAGAGCCGCCACTCTCGACCCCGGCTACTAC
ACGTACCGAAACTTCTTGAAGATTGAAGTCAGCCAGTCGCATCCAGCCATGACAGCCTTC
TGCTCCCTGCTCCTGCAAGCGCAGAGCCTCCTACCCAGGACCATGGCAGCCCCCAGGAC
AGCCTCAGACCAGGGGAGGAAGACGAAGGGATGCAGCTGCTACAGACAAAGGACTCCATG
GCCAAGGGAGCTAGGCCCGGGGCCAGCCGCGGCAGGGCTCGCTGGGGTCTGGCCTACACG
CTGCTGCACAACCCAACCCTGCAGGTCTTCCGCAAGACGGCCCTGTTGGGTGCCAATGGT
GCCCAGCCCTGAGGGCAGGGAAGGTCAACCCACCTGCCCATCTGTGCTGAGGCATGTTCC
TGCCTACCATCCTCCTCCCTCCCCGGCTCTCCTCCCAGCATCACACCAGCCATGCAGCCA
GCAGGTCCTCCGGATCACTGTGGTTGGGTGGAGGTCTGTCTGCACTGGGAGCCTCAGGAG
GGCTCTGCTCCACCCACTTGGCTATGGGAGAGCCAGCAGGGGTTCTGGAGAAAAAAACTG
GTGGGTTAGGGCCTTGGTCCAGGAGCCAGTTGAGCCAGGGCAGCCACATCCAGGCGTCTC
CCTACCCTGGCTCTGCCATCAGCCTTGAAGGGCCTCGATGAAGCCTTCTCTGGAACCACT
CCAGCCCAGCTCCACCTCAGCCTTGGCCTTCACGCTGTGGAAGCAGCCAAGGCACTTCCT
CACCCCCTCAGCGCCACGGACCTCTCTGGGGAGTGGCCGGAAAGCTCCCGGTCCTCTGGC
CTGCAGGGCAGCCCAAGTCATGACTCAGACCAGGTCCCACACTGAGCTGCCCACACTCGA
GAGCCAGATATTTTTGTAGTTTTTATGCCTTTGGCTATTATGAAAGAGGTTAGTGTGTTC
CCTGCAATAAACTTGTTCCTGAGAAAAAAAAAAAAAAAAAAAAAAAAAAAAAAAAAAAAA
AAAAAAAAAAAAAAAAAAAAAAAAAAAAA
```

FIGURE 80

Protein File:
MW: 73502.97, pI: 9.26
MSSQPAGNQTSPGATEDYSYGSWYIDEPQGGEELQPEGEVPSCHTSIPPGLYHACLASLS
ILVLLLLAMLVRRRQLWPDCVRGRPGLPSPVDFLAGDRPRAVPAAVFMVLLSSLCLLLPD
EDALPFLTLASAPSQDGKTEAPRGAWKILGLFYYAALYYPLAACATAGHTAAHLLGSTLS
WAHLGVQVWQRAECPQVPKIYKYYSLLASLPLLLGLGFLSLWYPVQLVRSFSRRTGAGSK
GLQSSYSEEYLRNLLCRKKLGSSYHTSKHGFLSWARVCLRHCIYTPQPGFHLPLKLVLSA
TLTGTAIYQVALLLLVGVVPTIQKVRAGVTTDVSYLLAGFGIVLSEDKQEVVELVKHHLW
ALEVCYISALVLSCLLTFLVLMRSLVTHRTNLRALHRGAALDLSPLHRSPHPSRQAIFCW
MSFSAYQTAFICLGLLVQQIIFFLGTTALAFLVLMPVLHGRNLLLFRSLESSWPFWLTLA
LAVILQNMAAHWVFLETHDGHPQLTNRRVLYAATFLLFPLNVLVGAMVATWRVLLSALYN
AIHLGQMDLSLLPPRAATLDPGYYTYRNFLKIEVSQSHPAMTAFCSLLLQAQSLLPRTMA
APQDSLRPGEEDEGMQLLQTKDSMAKGARPGASRGRARWGLAYTLLHNPTLQVFRKTALL
GANGAQP Important features of the protein:
Transmembrane domains:
Amino acids    54-69;102-119;148-166;207-222;301-320;
               364-380;431-451;474-489;512-531

N-glycosylation site:
Amino acids    8-12

N-myristoylation sites:
Amino acids    50-56;176-182;241-247;317-323;341-347;525-531;
               627-633;631-637;640-646;661-667

Prokaryotic membrane lipoprotein lipid attachment site:
Amino acids    364-375

ATP/GTP-binding site motif A (P-loop):
Amino acids    132-140

FIGURE 81

AAAAAATACAGCAGGTGAAGGAGGTTGGAGAGTAGGGGGTGGAGGGCCCACGCAGCACTTGT
CCTTCACCCTGGAGGGGATCTGTTACATGCCCCAGATTGCTGGTCCCCTAGAAATGTTACTG
AGGCAGCCTCTGCATTTTTGCAGGGATTGTTTTCTACTGTTTGACATTCACGTAACCTCCTA
ACGCTGTCTGGGGAAGATGCTACCCCCTGCTCTCCCCGTCTTTCCTGCACTCTCAGCAATGG
GATGGGCTGACTGATGCCCTGTGGGCTGGAAAGCTGACCACAGTTGCTGCAGACCAGACCCC
CTCACATAGTGAGTGCTGGGCTGAGGAATCCAGGAGAGCCCGAGGGGGACACTGAAGGTGT
ATCGTTGGCCCTGCCAGCTGCAAGTGAACTGCTTCTGATGAATTTTAATAGGGAGAAAGAAG
TATTTGCTAAGAATGGCAATCCTGACGCTCAGCCTTCAACTCATCTTGTTATTAATACCATC
AATATCCCATGAGGCTCATAAAACGAGTCTTTCTTCTTGGAAACATGACCAAGATTGGGCAA
ACGTCTCCAACATGACTTTCAGCAACGGAAAACTAAGAGTCAAAGGCATTTATTACCGGAAT
GCCGACATTTGCTCTCGACATCGCGTAACCTCAGCAGGCCTAACTCTGCAGGACCTTCAGCT
ATGGTGTAATTTGAGGTCAGTGGCCAGAGGACAGATCCCGTCTACATTATGAGTGAAGCGGAGA
GCTACTGCAGGGTTCTGAGCAGAGTCCTAATTTATATTTTAGAAGAATCATCATGGCTCCTA
GATTAGGAATAAAACGAAGGGGCCCAGGGATGGAAACGATGAGTCCAGTTGGGTTACTGCAA
AGATCCAGGCCAGAAATCCAGGCACAGTGGCACACACCTGAGTCCCAGATAATTCCACCTAC
TGGTCCTGCTCTGTGGCCTACTGGTCCGAGTCCAGCCCCGACTGATTTCTGGGCCTGTAATG
TCTAAAAACGCTCCCTGCTGATGTTTTGCAAGTGACTGTGTTACTTGAAGGCAGTTCCTAGG
ATAAACTAGTCGCTTTATCATTACAGAATCATTCACTGAGCATCAACTATGTAACCAGCATT
GGGTTGGGTGCCAGAGATCCAAAGCTAAGACACCAAAACCTGCTCTCCAGGAAACGAGAGGC
TGAGAA

FIGURE 82

></usr/seqdb2/sst/DNA/Dnaseqs.min/ss.DNA149995
><subunit 1 of 1, 95 aa, 1 stop
><MW: 10704, pI: 10.00, NX(S/T): 2
MAILTLSLQLILLLIPSISHEAHKTSLSSWKHDQDWANVSNMTFSNGKLRVKGIYYRNAD
ICSRHRVTSAGLTLQDLQLWCNLRSVARGQIPSTL

Important features of the protein:
Signal peptide:
Amino acids     1-19

N-glycosylation sites:
Amino acids     38-42;41-45

N-myristoylation site:
Amino acids     89-95

FIGURE 83

AATAGAAGTCCTCAGGACGGAGCAGAGGTGGCCGGCGGGCCCGGCTGACTGCGCCTCTGCTT
TCTTTCCATAACCTTTTCTTTCGGACTCGAATCACGGCTGCTGCGAAGGGTCTAGTTCCGGA
CACTAGGGTGCCCGAACGCGCTGATGCCCCGAGTGCTCGCAGGGCTTCCCGCTAACCATGCT
GCCGCCGCCGCGGCCCGCAGCTGCCTTGGCGCTGCCTGTGCTCCTGCTACTGCTGGTGGTGC
TGACGCCGCCCCGACCGGCGCAAGGCCATCCCCAGGCCCAGATTACCTGCGGCGCGGCTGG
ATGCGGCTGCTAGCGGAGGGCGAGGGCTGCGCTCCCTGCCGGCCAGAAGAGTGCGCCGCGCC
GCGGGGCTGCCTGGCGGGCAGGGTGCGCGACGCGTGCGGCTGCTGCTGGGAATGCGCCAACC
TCGAGGGCCAGCTCTGCGACCTGGACCCCAGTGCTCACTTCTACGGGCACTGCGGCGAGCAG
CTTGAGTGCCGGCTGGACACAGGCGGCGACCTGAGCCGCGGAGAGGTGCCGGAACCTCTGTG
TGCCTGTCGTTCGCAGAGTCCGCTCTGCGGGTCCGACGGTCACACCTACTCCCAGATCTGCC
GCCTGCAGGAGGCGGCCCGCGCTCGGCCCGATGCCAACCTCACTGTGGCACACCCGGGGCCC
TGCGAATCGGGGCCCCAGATCGTGTCACATCCATATGACACTTGGAATGTGACAGGGCAGGA
TGTGATCTTTGGCTGTGAAGTGTTTGCCTACCCCATGGCCTCCATCGAGTGGAGGAAGGATG
GCTTGGACATCCAGCTGCCAGGGGATGACCCCCACATCTCTGTGCAGTTTAGGGGTGGACCC
CAGAGGTTTGAGGTGACTGGCTGGCTGCAGATCCAGGCTGTGCGTCCCAGTGATGAGGGCAC
TTACCGCTGCCTTGGCCGCAATGCCCTGGGTCAAGTGGAGGCCCCTGCTAGCTTGACAGTGC
TCACACCTGACCAGCTGAACTCTACAGGCATCCCCCAGCTGCGATCACTAAACCTGGTTCCT
GAGGAGGAGGCTGAGAGTGAAGAGAATGACGATTACTACTAGGTCCAGAGCTCTGGCCCATG
GGGGTGGGTGAGCGGCTATAGTGTTCATCCCTGCTCTTGAAAAGACCTGGAAAGGGGAGCAG
GGTCCCTTCATCGACTGCTTTCATGCTGTCAGTAGGGATGATCATGGGAGGCCTATTTGACT
CCAAGGTAGCAGTGTGGTAGGATAGAGACAAAAGCTGGAGGAGGGTAGGGAGAGAAGCTGAG
ACCAGGACCGGTGGGGTACAAAGGGGCCCATGCAGGAGATGCCCTGGCCAGTAGGACCTCCA
ACAGGTTGTTTCCCAGGCTGGGGTGGGGGCCTGAGCAGACACAGAGGTGCAGGCACCAGGAT
TCTCCACTTCTTCCAGCCCTGCTGGCCACAGTTCTAACTGCCCTTCCTCCCAGGCCCTGGT
TCTTGCTATTTCCTGGTCCCCAACGTTTATCTAGCTTGTTTGCCCTTTCCCCAAACTCATCT
TCCAGAACTTTTCCCTCTCTCCTAAGCCCCAGTTGCACCTACTAACTGCAGTCCCTTTTGCT
GTCTGCCGTCTTTTGTACAAGAGAGAGAACAGCGGAGCATGACTTAGTTCAGTGCAGAGAGA
TTT

FIGURE 84

```
></usr/seqdb2/sst/DNA/Dnaseqs.min/ss.DNA167678
><subunit 1 of 1, 304 aa, 1 stop
><MW: 32945, pI: 4.69, NX(S/T): 3
MLPPPRPAAALALPVLLLLLVVLTPPPTGARPSPGPDYLRRGWMRLLAEGEGCAPCRPEE
CAAPRGCLAGRVRDACGCCWECANLEGQLCDLDPSAHFYGHCGEQLECRLDTGGDLSRGE
VPEPLCACRSQSPLCGSDGHTYSQICRLQEAARARPDANLTVAHPGPCESGPQIVSHPYD
TWNVTGQDVIFGCEVFAYPMASIEWRKDGLDIQLPGDDPHISVQFRGGPQRFEVTGWLQI
QAVRPSDEGTYRCLGRNALGQVEAPASLTVLTPDQLNSTGIPQLRSLNLVPEEEAESEEN
DDYY
```

Important features of the protein:
Signal peptide:
Amino acids 1-30

N-glycosylation sites:
Amino acids 159-163;183-187;277-281

Tyrosine kinase phosphorylation site:
Amino acids 244-252

N-myristoylation sites:
Amino acids 52-58;66-72;113-119;249-255

Kazal-type serine protease inhibitor domain:
Amino acids 121-168

Immunoglobulin domain:
Amino acids 186-255

Insulin-like growth factor binding proteins:
Amino acids 53-90

FIGURE 85

CAAAGCGGCGGCTGTCCGCGGTGCCGGCTGGGGCGGAGAGGCGGCGGTGGGCTCCCTGGGG
TGTGTGAGCCCGGTGATGGAGCCGGGCCCGACAGCCGCGCAGCGGAGGTGTTCGTTGCCGCC
GTGGCTGCCGCTGGGGCTGCTGCTGTGGTCGGGGCTGGCCCTGGGCGCGCTCCCCTTCGGCA
GCAGTCCGCACAGGGTCTTCCACGACCTCCTGTCGGAGCAGCAGTTGCTGGAGGTGGAGGAC
TTGTCCCTGTCCCTCCTGCAGGGTGGAGGGCTGGGGCCTCTGTCGCTGCCCCCGGACCTGCC
GGATCTGGATCCTGAGTGCCGGGAGCTCCTGCTGGACTTCGCCAACAGCAGCGCAGAGCTGA
CAGGGTGTCTGGTGCGCAGCGCCCGGCCCGTGCGCCTCTGTCAGACCTGCTACCCCCTCTTC
CAACAGGTCGTCAGCAAGATGGACAACATCAGCCGAGCCGCGGGGAATACTTCAGAGAGTCAG
AGTTGTGCCAGAAGTCTCTTAATGGCAGATAGAATGCAAATAGTTGTGATTCTCTCAGAATT
TTTTAATACCACATGGCAGGAGGCAAATTGTGCAAATTGTTTAACAAACAACAGTGAAGAAT
TATCAAACAGCACAGTATATTTCCTTAATCTATTTAATCACACCCTGACCTGCTTTGAACAT
AACCTTCAGGGGAATGCACATAGTCTTTTACAGACAAAAAATTATTCAGAAGTATGCAAAAA
CTGCCGTGAAGCATACAAAACTCTGAGTAGTCTGTACAGTGAAATGCAAAAATGAATGAAC
TTGAGAATAAGGCTGAACCTGGAACACATTTATGCATTGATGTGGAAGATGCAATGAACATC
ACTCGAAAACTATGGAGTCGAACTTTCAACTGTTCAGTCCCTTGCAGTGACACAGTGCCTGT
AATTGCTGTTTCTGTGTTCATTCTCTTTCTACCTGTTGTCTTCTACCTTAGTAGCTTTCTTC
ACTCAGAGCAAAAGAAACGCAAACTCATTCTGCCCAAACGTCTCAAGTCCAGTACCAGTTTT
GCAAATATTCAGGAAAATTCAAACTGAGACCTACAAAATGGAGAATTGACATATCACGTGAA
TGAATGGTGGAAGACACAACTTGGTTTCAGAAAGAAGATAAACTGTGATTTGACAAGTCAAG
CTCTTAAGAAATACAAGGACTTCAGATCCATTTTTAAATAAGAATTTTCGATTTTTCTTTCC
TTTTCCACTTCTTTCTAACAGATTTGGATATTTTAATTTCAG

FIGURE 86

```
></usr/seqdb2/sst/DNA/Dnaseqs.min/ss.DNA168028
><subunit 1 of 1, 334 aa, 1 stop
><MW: 37257, pI: 5.95, NX(S/T): 10
MEPGPTAAQRRCSLPPWLPLGLLLWSGLALGALPFGSSPHRVFHDLLSEQQLLEVEDLSL
SLLQGGGLGPLSLPPDLPDLDPECRELLLDFANSSAELTGCLVRSARPVRLCQTCYPLFQ
QVVSKMDNISRAAGNTSESQSCARSLLMADRMQIVVILSEFFNTTWQEANCANCLTNNSE
ELSNSTVYFLNLFNHTLTCFEHNLQGNAHSLLQTKNYSEVCKNCREAYKTLSSLYSEMQK
MNELENKAEPGTHLCIDVEDAMNITRKLWSRTFNCSVPCSDTVPVIAVSVFILFLPVVFY
LSSFLHSEQKKRKLILPKRLKSSTSFANIQENSN Important features of the protein:
Signal peptide:
Amino acids     1-31

Transmembrane domain:
Amino acids     278-300

N-glycosylation sites:
Amino acids     93-97;128-132;135-139;163-167;177-181;
                184-188;194-198;216-220;263-267;274-278 cAMP- and cGMP-dependent protein kinase phosphorylation site:
Amino acids     10-14

N-myristoylation sites:
Amino acids     27-33;206-212;251-257

Leucine zipper pattern:
Amino acids     190-212
```

FIGURE 87

```
ATGCTGGTAGCCGGCTTCCTGCTGGCGCTGCCGCCGAGCTGGGCCGCGGGCGCCCCCAGGGC
GGGCAGGCGCCCCGCGCGGCCGCGGGGCTGCGCGGACCGGCCGGAGGAGCTACTGGAGCAGC
TGTACGGGCGCCTGGCGGCCGGCGTGCTCAGTGCCTTCCACCACACGCTGCAGCTGGGGCCG
CGTGAGCAGGCGCGCAACGCGAGCTGCCCGGCAGGGGGCAGGCCCGGCGACCGCCGCTTCCG
GCCGCCCACCAACCTGCGCAGCGTGTCGCCCTGGGCCTACAGAATCTCCTACGACCCGGCGA
GGTACCCCAGGTACCTGCCTGAAGCCTACTGCCTGTGCCGGGGCTGCCTGACCGGGCTGTTC
GGCGAGGAGGACGTGCGCTTCCGCAGCGCCCTGTCTACATGCCCACCGTCGTCCTGCGCCG
CACCCCCGCCTGCGCCGGCGGCCGTTCCGTCTACACCGAGGCCTACGTCACCATCCCCGTGG
GCTGCACCTGCGTCCCCGAGCCGGAGAAGGACGCAGACAGCATCAACTCCAGCATCGACAAA
CAGGGCGCCAAGCTCCTGCTGGGCCCCAACGACGCGCCCGCTGGCCCCTGAGGCCGGTCCTG
CCCCGGGAGGTCTCCCCGGCCCGCATCCCGAGGCGCCCAAGCTGGAGCCGCCTGGAGGGCTC
GGTCGGCGACCTCTGAAGAGAGTGCACCGAGCAAACCAAGTGCCGGAGCACCAGCGCCGCCT
TTCCATGGAGACTCGTAAGCAGCTTCATCTGACACGGGCATCCCTGGCTTGCTTTTAGCTAC
AAGCAAGCAGCGTGGCTGGAAGCTGATGGGAAACGACCCGGCACGGGCATCCTGTGTGCGGC
CCGCATGGAGGGTTTGGAAAAGTTCACGGAGGCTCCCTGAGGAGCCTCTCAGATCGGCTGCT
GCGGGTGCAGGGCGTGACTCACCGCTGGGTGCTTGCCAAAGAGATAGGGACGCATATGCTTT
TTAAAGCAATCTAAAAATAATAATAAGTATAGCGACTATATACCTACTTTTAAAATCAACTG
TTTTGAATAGAGGCAGAGCTATTTTATATTATCAAATGAGAGCTACTCTGTTACATTTCTTA
ACATATAAACATCGTTTTTTACTTCTTCTGGTAGAATTTTTTAAAGCATAATTGGAATCCTT
GGATAAATTTTGTAGCTGGTACACTCTGGCCTGGGTCTCTGAATTCAGCCTGTCACCGATGG
CTGACTGATGAAATGGACACGTCTCATCTGACCCACTCTTCCTTCCACTGAAGGTCTTCACG
GGCCTCCAGGTGGACCAAAGGGATGCACAGGCGGCTCGCATGCCCCAGGGCCAGCTAAGAGT
TCCAAAGATCTCAGATTTGGTTTTAGTCATGAATACATAAACAGTCTCAAACTCGCACAATT
TTTTCCCCCTTTTGAAAGCCACTGGGGCCAATTTGTGGTTAAGAGGTGGTGAGATAAGAAGT
GGAACGTGACATCTTTGCCAGTTGTCAGAAGAATCCAAGCAGGTATTGGCTTAGTTGTAAGG
GCTTTAGGATCAGGCTGAATATGAGGACAAAGTGGGCCACGTTAGCATCTGCAGAGATCAAT
CTGGAGGCTTCTGTTTCTGCATTCTGCCACGAGAGCTAGGTCCTTGATCTTTTCTTTAGATT
GAAAGTCTGTCTCTGAACACAATTATTTGTAAAAGTTAGTAGTTCTTTTTTAAATCATTAAA
AGAGGCTTGCTGAAGGAT
```

FIGURE 88

```
></usr/seqdb2/sst/DNA/Dnaseqs.min/ss.DNA173894
><subunit 1 of 1, 202 aa, 1 stop
><MW: 21879, pI: 9.30, NX(S/T): 2
MLVAGFLLALPPSWAAGAPRAGRRPARPRGCADRPEELLEQLYGRLAAGVLSAFHHTLQL
GPREQARNASCPAGGRPGDRRFRPPTNLRSVSPWAYRISYDPARYPRYLPEAYCLCRGCL
TGLFGEEDVRFRSAPVYMPTVVLRRTPACAGGRSVYTEAYVTIPVGCTCVPEPEKDADSI
NSSIDKQGAKLLLGPNDAPAGP Important features of the protein:
Signal peptide:
Amino acids      1-15

N-glycosylation sites:
Amino acids      68-72;181-185

Tyrosine kinase phosphorylation site:
Amino acids      97-106

N-myristoylation sites:
Amino acids      17-23;49-55;74-80;118-124

Amidation site:
Amino acids      21-25
```

FIGURE 89

```
CCGGGGCCTCCGGAGAACGCTGTCCCATGAACGTGCGGGGAGCGGCCCCCGGCGTCCGCGCG
TCCCCGCGTCCCTGGCAATTCCCGACTTCCCAACGGCTTCCCGCTGGCAGCCCCGAAGCCGC
ACCATGTTCCGCCTCTGGTTGCTGCTGGCCGGGCTCTGCGGCCTCCTGGCGTCAAGACCCGGT
TTTCAAAATTCACTTCTACAGATCGTAATTCCAGAGAAAATCCAAACAAATACAAATGACAG
TTCAGAAATAGAATATGAACAAATATCCTATATTATTCCAATAGATGAGAAACTGTACACTG
TGCACCTTAAACAAAGATATTTTTTAGCAGATAATTTTATGATCTATTTGTACAATCAAGGA
TCTATGAATACTTATTCTTCAGATATTCAGACTCAATGCTACTATCAAGGAAATATTGAAGG
ATATCCAGATTCCATGGTCACACTCAGCACGTGCTCTGGACTAAGAGGAATACTGCAATTTG
AAAATGTTTCTTATGGAATTGAGCCTCTGGAATCTGCAGTTGAATTTCAGCATGTTCTTTAC
AAATTAAAGAATGAAGACAATGATATTGCAATTTTTATTGACAGAAGCCTGAAAGAACAACC
AATGGATGACAACATTTTTATAAGTGAAAAATCAGAACCAGCTGTTCCAGATTTATTTCCTC
TTTATCTAGAAATGCATATTGTGGTGGACAAAACTTTGTATGATTACTGGGGCTCTGATAGC
ATGATAGTAACAAATAAAGTCATCGAAATTGTTGGCCTTGCAAATTCAATGTTCACCCAATT
TAAAGTTACTATTGTGCTGTCATCATTGGAGTTATGGTCAGATGAAAATAAGATTTCTACAG
TTGGTGAGGCAGATGAATTATTGCAAAAATTTTTAGAATGGAAACAATCTTATCTTAACCTA
AGGCCTCATGATATTGCATATCTACTAATTTATATGGATTATCCTCGTTATTTGGGAGCAGT
GTTTCCTGGAACAATGTGTATTACTCGTTATTCTGCAGGAGTTGCATTGTACCCCAAGGAGA
TAACTCTGGAGGCATTTGCAGTTATTGTCACCCAGATGCTGGCACTCAGTCTGGGAATATCA
TATGACGACCCAAAGAAATGTCAATGTTCAGAATCCACCTGTATAATGAATCCAGAAGTTGT
GCAATCCAATGGTGTGAAGACTTTTAGCAGTTGCAGTTTGAGGAGCTTTCAAAATTTCATTT
CAAATGTGGGTGTCAAATGTCTTCAGAATAAGCCACAAATGCAAAAAAATCTCCGAAACCA
GTCTGTGGCAATGGCAGATTGGAGGGAAATGAAATCTGTGATTGTGGTACTGAGGCTCAATG
TGGACCTGCAAGCTGTTGTGATTTTCGAACTTGTGTACTGAAAGACGGAGCAAAATGTTATA
AAGGACTGTGCTGCAAAGACTGTCAAATTTTACAATCAGGCGTTGAATGTAGGCCGAAAGCA
CATCCTGAATGTGACATCGCTGAAAATTGTAATGGAAGCTCACCAGAATGTGGTCCTGACAT
AACTTTAATCAATGGACTTTCATGCAAAATAATAAGTTTATTTGTTATGACGGAGACTGCC
ATGATCTCGATGCACGTTGTGAGAGTGTATTTGGAAAAGGTTCAAGAAATGCTCCATTTGCC
TGCTATGAAGAAATACAATCTCAATCAGACAGATTTGGGAACTGTGGTAGGGATAGAAATAA
CAAATATGTGTTCTGTGGATGGAGGAATCTTATATGTGGAAGATTAGTTTGTACCTACCCTA
CTCGAAAGCCTTTCCATCAAGAAAATGGTGATGTGATTTATGCTTTCGTACGAGATTCTGTA
TGCATAACTGTAGACTACAAATTGCCTCGAACAGTTCCAGATCCACTGGCTGTCAAAAATGG
CTCTCAGTGTGATATTGGGAGGGTTTGTGTAAATCGTGAATGTGTAGAATCAAGGATAATTAAG
GCTTCAGCACATGTTTGTTCACAACAGTGTTCTGGACATGGAGTGTGTGATTCCAGAAACAA
GTGCCATTGTTCGCCAGGCTATAAGCCTCCAAACTGCCAAATACGTTCCAAAGGATTTTCCA
TATTTCCTGAGGAAGATATGGGTTCAATCATGGAAAGAGCATCTGGGAAGACTGAAAACACC
TGGCTTCTAGGTTTCCTCATTGCTCTTCCTATTCTCATTGTAACAACCGCAATAGTTTTGGC
AAGGAAACAGTTGAAAAAGTGGTTCGCCAAGGAAGAGGAATTCCCAAGTAGCGAATCTAAAT
CGGAAGGTAGCACACAGACATATGCCAGCCAATCCAGCTCAGAAGGCAGCACTCAGACATAT
GCCAGCCAAACCAGATCAGAAAGCAGCAGTCAAGCTGATACTAGCAAATCCAAATCAGAAGA
TAGTGCTGAAGCATATACTAGCAGATCCAAATCACAGGACAGTACCCAAACACAAAGCAGTA
GTAACTAGTGATTCCTTCAGAAGGCAACGGATAACATCGAGAGTCTCGCTAAGAAATGAAAA
TTCTGTCTTTCCTTCCGTGGTCACAGCTGAAAGAAACAATAAATTGAGTGTGGATC
```

FIGURE 90

```
></usr/seqdb2/sst/DNA/Dnaseqs.min/ss.DNA176775
><subunit 1 of 1, 787 aa, 1 stop
><MW: 87934, pI: 5.49, NX(S/T): 4
MFRLWLLLAGLCGLLASRPGFQNSLLQIVIPEKIQTNTNDSSEIEYEQISYIIPIDEKLY
TVHLKQRYFLADNFMIYLYNQGSMNTYSSDIQTQCYYQGNIEGYPDSMVTLSTCSGLRGI
LQFENVSYGIEPLESAVEFQHVLYKLKNEDNDIAIFIDRSLKEQPMDDNIFISEKSEPAV
PDLFPLYLEMHIVVDKTLYDYWGSDSMIVTNKVIEIVGLANSMFTQFKVTIVLSSLELWS
DENKISTVGEADELLQKFLEWKQSYLNLRPHDIAYLLIYMDYPRYLGAVFPGTMCITRYS
AGVALYPKEITLEAFAVIVTQMLALSLGISYDDPKKCQCSESTCIMNPEVVQSNGVKTFS
SCSLRSFQNFISNVGVKCLQNKPQMQKKSPKPVCGNGRLEGNEICDCGTEAQCGPASCCD
FRTCVLKDGAKCYKGLCCKDCQILQSGVECRPKAHPECDIAENCNGSSPECGPDITLING
LSCKNNKFICYDGDCHDLDARCESVFGKGSRNAPFACYEEIQSQSDRFGNCGRDRNNKYV
FCGWRNLICGRLVCTYPTRKPFHQENGDVIYAFVRDSVCITVDYKLPRTVPDPLAVKNGS
QCDIGRVCVNRECVESRIIKASAHVCSQQCSGHGVCDSRNKCHCSPGYKPPNCQIRSKGF
SIFPEEDMGSIMERASGKTENTWLLGFLIALPILIVTTAIVLARKQLKKWFAKEEEFPSS
ESKSEGSTQTYASQSSSEGSTQTYASQTRSESSSQADTSKSKSEDSAEAYTSRSKSQDST
QTQSSSN
```

Important features of the protein:
Signal peptide:
Amino acids     1-16

Transmembrane domain:
Amino acids     309-326;681-705

N-glycosylation sites:
Amino acids     39-43;125-129;465-469;598-602

Glycosaminoglycan attachment site:
Amino acids     631-635

Tyrosine kinase phosphorylation site:
Amino acids     269-276

N-myristoylation sites:
Amino acids     13-19;82-88;99-105;218-224;401-407;634-640;
              726-732;739-745

EGF-like domain proteins:
Amino acids     642-654

Disintegrins proteins:
Amino acids     400-407;422-472;403-453;467-517;634-684

Reprolysin (M12B) family zinc metalloprotease:
Amino acids     186-383

Reprolysin family propeptide:
Amino acids     63-176

FIGURE 91

```
CACCAGACAGCACTCCAGCACTCTGTTTGGGGGGCATTCGAAACAGCAAAATCACTCATAAA
AGGCAAAAAATTGCAAAAAAAATAGTAATAACCAGCATGGCACTAAATAGACCATGAAAAG
ACATGTGTGTGCAGTATGAAAATTGAGACAGGAAGGCAGAGTGTCAGCTTGTTCCACCTCAG
CTGGGAATGTGCATCAGGCAACTCAAGTTTTTCACCACGGCATGTGTCTGTGAATGTCCGCA
AACATTCTCTCTCCCCAGCCTTCATGTGTTAACCTGGGGATGATGTGGACCTGGGCACTGTGG
ATGCTCCCTTCACTCTGCAAATTCAGCCTGGCAGCTCTGCCAGCTAAGCCTGAGAACATTTC
CTGTGTCTACTACTATAGGAAAAATTTAACCTGCACTTGGAGTCCAGGAAAGGAAACCAGTT
ATACCCAGTACACAGTTAAGAGAACTTACGCTTTTGGAGAAAAACATGATAATTGTACAACC
AATAGTTCTACAAGTGAAAATCGTGCTTCGTGCTCTTTTTCCTTCCAAGAATAACGATCCC
AGATAATTATACCATTGAGGTGGAAGCTGAAAATGGAGATGGTGTAATTAAATCTCATATGA
CATACTGGAGATTAGAGAACATAGCGAAAACTGAACCACCTAAGATTTTCCGTGTGAAACCA
GTTTTGGGCATCAAACGAATGATTCAAATTGAATGGATAAAGCCTGAGTTGGCGCCTGTTTC
ATCTGATTTAAAATACACACTTCGATTCAGGACAGTCAACAGTACCAGCTGGATGGAAGTCA
ACTTCGCTAAGAACCGTAAGGATAAAAACCAAACGTACAACCTCACGGGGCTGCAGCCTTTT
ACAGAATATGTCATAGCTCTGCGATGTGCGGTCAAGGAGTCAAAGTTCTGGAGTGACTGGAG
CCAAGAAAAATGGGAATGACTGAGGAAGAAGCTCCATGTGGCCTGGAACTGTGGAGAGTCC
TGAAACCAGCTGAGGCGGATGGAAGAAGGCCAGTGCGGTTGTTATGGAAGAAGGCAAGAGGA
GCCCCAGTCCTAGAGAAAACACTTGGCTACAACATATGGTACTATCCAGAAAGCAACACTAA
CCTCACAGAAACAATGAACACTACTAACCAGCAGCTTGAACTGCATCTGGGAGGCGAGAGCT
TTTGGGTGTCTATGATTTCTTATAATTCTCTTGGGAAGTCTCCAGTGGCCACCCTGAGGATT
CCAGCTATTCAAGAAAATCATTTCAGTGCATTGAGGTCATGCAGGCCTGCGTTGCTGAGGA
CCAGCTAGTGGTGAAGTGGCAAAGCTCTGCTCTAGACGTGAACACTTGGATGATTGAATGGT
TTCCGGATGTGGACTCAGAGCCCACCACCCTTTCCTGGGAATCTGTGTCTCAGGCCACGAAC
TGGACGATCCAGCAAGATAAATTAAAACCTTTCTGGTGCTATAACATCTCTGTGTATCCAAT
GTTGCATGACAAAGTTGGCGAGCCATATTCCATCCAGGCTTATGCCAAAGAAGGCGTTCCAT
CAGAAGGTCCTGAGACCAAGGTGGAGAACATTGGCGTGAAGACGGTCACGATCACATGGAAA
GAGATTCCCAAGAGTGAGAGAAAGGGTATCATCTGCAACTACACCATCTTTTACCAAGCTGA
AGGTGGAAAAGGATTCTGTAAGCACGCCCATAGCGAAGTGGAAAAAACCCCAAGCCCCAGA
TAGATGCTATGGATAGACCTGTTGTAGGCATGGCTCCCCCATCTCATTGTGACTTGCAACCT
GGCATGAATCACTTAGCTTCTTTAAATCTCTCTGAAAATGGGGCCAAGAGCACCCACCTTTT
GGGGTTTTGGGGGTTAAATGAGAGTGAAGTGACAGTACCTGAGAGGAGAGTCCTGAGGAAAT
GGAAGGAGTTGTTATAATTTGTCCTGGTTAGGCCCTGAATTGACCTCCCGGGAGCTCCCCGA
CCATCATTCCCAGGAATGGCGTGCCTGGCTTAAAGAGTGAGGAGGAACAGACCCTGTCACCA
TGACTTCTACTGCCCCTGCCAAATCATGCTTTTGTTTTCAGTCCACCTTATCTCCTGACATCT
TAAATACTGGGCAAGGCTTGGATTCTTGCTTAGGCTAAATAATTTTTTCTTATGGTAAAATA
CACGTAAAATATTTTTCCAGTTTAAACATTTGAAAGTGTACAATTTAGTGGCATTAGAAGCA
TTCACAATATTGTGCAACCATCACCACTATTTCCAGAACTCTTCTATTTCTGCCCAAATAGA
AGCCCTATACCCATTCATTAGTCACTCCCCATTCCTCTCCTCCCACAGCCCCTGGCAACTAC
CAAACTGCTTTGTGTCTCTATGGATTGCCTATTTTGGATATTTCATATACATAGAATCATAA
ANTAAAAAAAAAAAAAAAAAAAA
```

FIGURE 92

```
></usr/seqdb2/sst/DNA/Dnaseqs.min/ss.DNA177313
><subunit 1 of 1, 582 aa, 1 stop
><MW: 66605, pI: 8.14, NX(S/T): 15
MCIRQLKFFTTACVCECPQNILSPQPSCVNLGMMWTWALWMLPSLCKFSLAALPAKPENI
SCVYYYRKNLTCTWSPGKETSYTQYTVKRTYAFGEKHDNCTTNSSTSENRASCSFFLPRI
TIPDNYTIEVEAENGDGVIKSHMTYWRLENIAKTEPPKIFRVKPVLGIKRMIQIFWIKPE
LAPVSSDLKYTLRFRTVNSTSWMEVNFAKNRKDKNQTYNLTGLQPFTEYVIALRCAVKES
KFWSDWSQEKMGMTEEEAPCGLELWRVLKPAEADGRRPVRLLWKKARGAPVLEKTLGYNI
WYYPESNTNLTETMNTTNQQLELHLGGESFWVSMISYNSLGKSPVATLRIPAIQEKSFQC
IEVMQACVAEDQLVVKWQSSALDVNTWMIEWFPDVDSEPTTLSWESVSQATNWTIQQDKL
KPFWCYNISVYPMLHDKVGEPYSIQAYAKEGVPSEGPETKVENIGVKTVTITWKEIPKSE
RKGIICNYTIFYQAEGGKGFCKHAHSEVEKNPKPQIDAMDRPVVGMAPPSHCDLQPGMNH
LASLNLSENGAKSTHLLGFWGLNESEVTVPERRVLRKWKELL Important features of the protein:
Signal peptide:
Amino acids      1-46

N-glycosylation sites:
Amino acids      59-63;69-73;99-103;103-107;125-129;198-202;
                 215-219;219-223;309-313;315-319;412-416;
                 427-431;487-491;545-549;563-567

N-myristoylation sites:
Amino acids      32-38;137-143;483-489;550-556;561-567

Amidation site:
Amino acids      274-278

Growth factor and cytokines receptors family signature 1:
Amino acids      62-75

Fibronectin type III domain:
Amino acids      54-144;154-247
```

FIGURE 93

ATTCTCCTAGAGCATCTTTGGAAGCATGAGGCCACGATGCTGCATCTTGGCTCTTGTCTGCT
GGATAACAGTCTTCCTCCTCCAGTGTTCAAAAGGAACTACAGACGCTCCTGTTGGCTCAGGA
CTGTGGCTGTGCCAGCCGACACCCAGGTGTGGGAACAAGATCTACAACCCTTCAGAGCAGTG
CTGTTATGATGATGCCATCTTATCCTTAAAGGAGACCCGCCGCTGTGGCTCCACCTGCACCT
TCTGGCCCTGCTTTGAGCTCTGCTGTCCCGAGTCTTTTGGCCCCAGCAGAAGTTTCTTGTG
AAGTTGAGGGTTCTGGGTATGAAGTCTCAGTGTCACTTATCTCCCATCTCCCGGAGCTGTAC
CAGGAACAGGAGGCACGTCCTGTACCCATAAAAACCCCAGGCTCCACTGGCAGACGGCAGAC
AAGGGGAGAAGAGACGAAGCAGCTGGACATCGGAGACTACAGTTGAACTTCGGAGAGAAGCA
ACTTGACTTCAGAGGGATGGCTCAATGACATAGCTTTGGAGAGGAGCCCAGCTGGGGATGGC
CAGACTTCAGGGGAAGAATGCCTTCCTGCTTCATCCCCTTTCCAGCTCCCCTTCCCGCTGAG
AGCCACTTTCATCGGCAATAAAATCCCCCACATTTACCATCT

FIGURE 94

</usr/seqdb2/sst/DNA/Dnaseqs.min/ss.DNA57700
<subunit 1 of 1, 125 aa, 1 stop
<MW: 14198, pI: 9.01, NX(S/T): 1
MRPRCCILALVCWITVFLLQCSKGTTDAPVGSGLWLCQPTPRCGNKIYNPSEQCCYDDAI
LSLKETRRCGSTCTFWPCFELCCPESFGPQQKFLVKLRVLGMKSQCHLSPISRSCTRNRR
HVLYP

Important features:
Signal peptide:
Amino acids     1-21

N-myristoylation sites:
Amino acids     33-39;70-76

Anaphylatoxin domain proteins:
Amino acids     50-60

FIGURE 95

GCATTTTTGTCTGTGCTCCCTGATCTTCAGGTCACCACCATGAAGTTCTTAGCAGTCCTGGT
ACTCTTGGGAGTTTCCATCTTTCTGGTCTCTGCCCAGAATCCGACAACAGCTGCTCCAGCTG
ACACGTATCCAGCTACTGGTCCTGCTGATGATGAAGCCCCTGATGCTGAAACCACTGCTGCT
GCAACCACTGCGACCACTGCTGCTCCTACCACTGCAACCACCGCTGCTTCTACCACTGCTCG
TAAAGACATTCCAGTTTTACCCAAATGGGTTGGGGATCTCCCGAATGGTAGAGTGTGTCCCT
GAGATGGAATCAGCTTGAGTCTTCTGCAATTGGTCACAACTATTCATGCTTCCTGTGATTTC
ATCCAACTACTTACCTTGCCTACGATATCCCCTTTATCTCTAATCAGTTTATTTTCTTTCAA
ATAAAAAATAACTATGAGCAACATAAAAAAAAAAAA

FIGURE 96

```
</usr/seqdb2/sst/DNA/Dnaseqs.min/ss.DNA62872
<subunit 1 of 1, 90 aa, 1 stop
<MW: 9039, pI: 4.37, NX(S/T): 1
MKFLAVLVLLGVSIFLVSAQNPTTAAPADTYPATGPADDEAPDAETTAAATTATTAAPTT
ATTAASTTARKDIPVLPKWVGDLPNGRVCP
```

Important features:
Signal peptide:
Amino acids    1-19

FIGURE 97

GGACTCTGAAGGTCCCAAGCAGCTGCTGAGGCCCCCAAGGAAGTGGTTCCAACCTTGGACCC
CTAGGGGTCTGGATTTGCTGGTTAACAAGATAACCTGAGGGCAGGACCCCATAGGGGAATGC
TACCTCCTGCCCTTCCACCTGCCCTGGTGTTCACGGTGGCCTGGTCCCTCCTTGCCGAGAGA
GTGTCCTGGGTCAGGGACGCAGAGGACGCTCACAGACTCCAGCCCTTTGTTACCGAGAGGAC
ACTTGGCAAGGTCCAGCGATGGTCCGGAGTCCACACACAGACTGGCGGCAGGGCAGGAGGGG
GACAGTTCTGTTGTGCTTGGTTGGACAGTAAGAGGGTCTTGGCCAGTCCAGGGTGGGGGGCG
GCAAACTCCATAAAGAACCAGAGGGTCTGGGCCCCGGCCACAGAGTCATCTGCCCAGCTCCT
CTGCTGCTGGCCAGTGGGAGTGGCACGAGGTGGGGCTTTGTGCCAGTAAAACCACAGGCTGG
ATTTGCCTGCGGGCCATGGTCCCTGTCTAGGGCAGCAATTCTCAACCTTCTTGCTCTCAGGA
CCCCAAAGAGCTTTCATTGTATCTATTGATTTTTACCACATTAGCAATTAAAACTGAGAAAT
GGGCCGGGCACGGTGGCTCACGCCTGTAATCCCAGCACTTTGGGAGGCCGAGGCGGGTGGAT
CACCTGAGATCAGGAGTTCAAGACCAGCCTGGCCAACATGGTGAAACCTTGTCTACTAAAAA
TACAAAAAATTAGCCAGGCACAGTGGTGTGCACTGGTAGTCCCAGTTACTCGGGAGGCTGAG
GCAGGAAAATCGCTTGAACCCAGGAGGCGGACGTTGCGGTGAGCCGAGATCGCGCCGCTGAT
TCCAGCCTGGGCGACAAGAGTGAGACTCCATCTCACACA

FIGURE 98

```
</usr/seqdb2/sst/DNA/Dnaseqs.min/ss.DNA62876
<subunit 1 of 1, 120 aa, 1 stop
<MW: 12925, pI: 9.46, NX(S/T): 0
MLPPALPPALVFTVAWSLLAERVSWVRDAEDAHRLQPFVTERTLGKVQRWSGVHTQTGGR
AGGGQFCCAWLDSKRVLASPGWGAANSIKNQRVWAPATESSAQLLCCWPVGVARGGALCQ
```

Important features:
Signal peptide:
Amino acids    1-17

N-myristoylation sites:
Amino acids    58-64;63-69;64-70;83-89;111-117;115-121

FIGURE 99

AATTTTTCACCAGAGTAAACTTGAGAAACCAACTGGACCTTGAGTATTGTACATTTTGCCTC
GTGGACCCAAAGGTAGCAATCTGAAACATGAGGAGTACGATTCTACTGTTTTGTCTTCTAGG
ATCAACTCGGTCATTACCACAGCTCAAACCTGCTTTGGGACTCCCTCCCACAAAACTGGCTC
CGGATCAGGGAACACTACCAAACCAACAGCAGTCAAATCAGGTCTTTCCTTCTTTAAGTCTG
ATACCATTAACACAGATGCTCACACTGGGGCCAGATCTGCATCTGTTAAATCCTGCTGCAGG
AATGACACCTGGTACCCAGACCCACCCATTGACCCTGGGAGGGTTGAATGTACAACAGCAAC
TGCACCCACATGTGTTACCAATTTTTGTCACACAACTTGGAGCCCAGGGCACTATCCTAAGC
TCAGAGGAATTGCCACAAATCTTCACGAGCCTCATCATCCATTCCTTGTTCCCGGGAGGCAT
CCTGCCCACCAGTCAGGCAGGGGCTAATCCAGATGTCCAGGATGGAAGCCTTCCAGCAGGAG
GAGCAGGTGTAAATCCTGCCACCCAGGGAACCCCAGCAGGCCGCCTCCCAACTCCCAGTGGC
ACAGATGACGACTTTGCAGTGACCACCCCTGCAGGCATCCAAAGGAGCACACATGCCATCGA
GGAAGCCACCACAGAATCAGCAAATGGAATTCAGTAAGCTGTTTCAAATTTTTTCAACTAAG
CTGCCTCGAATTTGGTGATACATGTGAATCTTTATCATTGATTATATTATGGAATAGATTGA
GACACATTGGATAGTCTTAGAAGAAATTAATTCTTAATTTACCTGAAAATATTCTTGAAATTT
CAGAAAATATGTTCTATGTAGAGAATCCCAACTTTTAAAAACAATAATTCAATGGATAAATC
TGTCTTTGAAATATAACATTATGCTGCCTGGATGATATGCATATTAAAACATATTTGGAAAA
CTGGAAAAAAAAAAAAAAAAAAAAAAAAAAAAAAAAAAAAAAAAAAAAAAAAAAAAAAAAAA
AAAAAAAAAAAAAAAAA

FIGURE 100

```
></usr/seqdb2/sst/DNA/Dnaseqs.min/ss.DNA66660
><subunit 1 of 1, 209 aa, 1 stop
><MW: 21588, pI: 5.50, NX(S/T): 0
MRSTILLFCLLGSTRSLPQLKPALGLPPTKLAPDQGTLPNQQQSNQVFPSLSLIPLTQML
TLGPDLHLLNPAAGMTPGTQTHPLTLGGLNVQQQLHPHVLPIFVTQLGAQGTILSSEELP
QIFTSLIIHSLFPGGILPTSQAGANPDVQDGSLPAGGAGVNPATQGTPAGRLPTPSGTDD
DFAVTTPAGIQRSTHAIEEATTESANGIQ
```

Important features of the protein:
Signal peptide:
Amino acids    1-16

Leucine zipper patterns:
Amino acids    10-32;17-39

N-myristoylation sites:
Amino acids    12-18;25-31;36-42;74-80;108-114;111-117;
               135-141;151-157;159-165;166-172;189-195

FIGURE 101

GGGGTCTCCCTCAGGGCCGGGAGGCACAGCGGTCCCTGCTTGCTGAAGGGCTGGATGTACGC
ATCCGCAGGTTCCCGCGGACTTGGGGGCGCCCGCTGAGCCCCGGCGCCCGCAGAAGACTTGT
GTTTGCCTCCTGCAGCCTCAACCCGGAGGGCAGCGAGGGCCTACCACATGATCACTGGTGT
GTTCAGCATGCGCTTGTGGACCCCAGTGGGCGTCCTGACCTCGCTGGCGTACTGCCTGCACC
AGCGGCGGGTGGCCCTGGCCGAGCTGCAGGAGGCCGATGGCCAGTGTCCGGTCGACCGCAGC
CTGCTGAAGTTGAAAATGGTGCAGGTCGTGTTTCGACACGGGGCTCGGAGTCCTCTCAAGCC
GCTCCCGCTGGAGGAGCAGGTAGAGTGGAACCCCAGCTATTAGAGGTCCCACCCCAAACTC
AGTTTGATTACACAGTCACCAATCTAGCTGGTGGTCCGAAACCATATTCTCCTTACGACTCT
CAATACCATGAGACCACCCTGAAGGGGGGCATGTTTGCTGGGCAGCTGACCAAGGTGGGCAT
GCAGCAAATGTTTGCCTTGGGAGAGAGACTGAGGAAGAACTATGTGGAAGACATTCCCTTTC
TTTCACCAACCTTCAACCCACAGGAGGTCTTTATTCGTTCCACTAACATTTTTCGGAATCTG
GAGTCCACCCGTTGTTTGCTGGCTGGGCTTTTCCAGTGTCAGAAAGAAGGACCCATCATCAT
CCACACTGATGAAGCAGATTCAGAAGTCTTGTATCCCAACTACCAAAGCTGCTGGAGCCTGA
GGCAGAGAACCAGAGGCCGGAGGCAGACTGCCTCTTTACAGCCAGGAATCTCAGAGGATTTG
AAAAAGGTGAAGGACAGGATGGGCATTGACAGTAGTGATAAAGTGGACTTCTTCATCCTCCT
GGACAACGTGGCTGCCGAGCAGGCACACAACCTCCCAAGCTGCCCCATGCTGAAGAGATTTG
CACGGATGATCGAACAGAGAGCTGTGGACACATCCTTGTACATACTGCCCAAGGAAGACAGG
GAAAGTCTTCAGATGGCAGTAGGCCCATTCCTCCACATCCTAGAGAGCAACCTGCTGAAAGC
CATGGACTCTGCCACTGCCCCCGACAAGATCAGAAAGCTGTATCTCTATGCGGCTCATGATG
TGACCTTCATACCGCTCTTAATGACCCTGGGGATTTTTGACCACAAATGGCCACCGTTTGCT
GTTGACCTGACCATGGAACTTTACCAGCACCTGGAATCTAAGGAGTGGTTTGTGCAGCTCTA
TTACCACGGGAAGGAGCAGGTGCCGAGAGGTTGCCCTGATGGGCTCTGCCCGCTGGACATGT
TCTTGAATGCCATGTCAGTTTATACCTTAAGCCCAGAAAAATACCATGCACTCTGCTCTCAA
ACTCAGGTGATGGAAGTTGGAAATGAAGAGTAACTGATTTATAAAAGCAGGATGTGTTGATT
TTAAAATAAAGTGCCTTTATACAATG

FIGURE 102

MITGVFSMRLWTPVGVLTSLAYCLHQRRVALAELQEADGQCPVDRSLLKLKMVQVVFRHGARSPLKPLPLEEQV
EWNPQLLEVPPQTQFDYTVTNLAGGPKPYSPYDSQYHETTLKGGMFAGQLTKVGMQQMFALGERLRKNYVEDIP
FLSPTFNPQEVFIRSTNIFRNLESTRCLLAGLFQCQKEGPIIHTDEADSEVLYPNYQSCWSLRQRTRGRRQTA
SLQPGTSEDLKKVKDRMGIDSSDKVDFFILLDNVAAEQAHNLPSCPMLKRFARMIEQRAVDTSLYILPKEDRES
LQMAVGPFLHILESNLLKAMDSATAPDKIRKLYLYAAHDVTFIPLLMTLGIFDHKWPPFAVDLTMELYQHLESK
EWFVQLYYHGKEQVPRGCPDGLCPLDMFLNAMSVYTLSPEKYHALCSQTQVMEVGNEF

Important features:
Signal sequence:
amino acids 1-23 cAMP- and cGMP-dependent protein kinase phosphorylation site.
amino acids 218-222

Casein kinase II phosphorylation site.
amino acids 87-91, 104-108, 320-324

Tyrosine kinase phosphorylation site.
amino acids 280-288

N-myristoylation site.
amino acids 15-21, 117-123, 118-124, 179-185, 240-246, 387-393

Amidation site.
amino acids 216-220

Leucine zipper pattern.
amino acids 10-32

Histidine acid phosphatases phosphohistidine signature.
amino acids 50-65

FIGURE 103

```
GGGGCGGGTGGACGCGGACTCGAACGCAGTTGCTTCGGGACCCAGGACCCCCTCGGGCCCGA
CCCGCCAGGAAAGACTGAGGCCGCGGCCTGCCCCGCCGGCTCCCTGCGCCGCCGCCGCCTC
CCGGGACAGAAGATGTGCTCCAGGGTCCCTCTGCTGCTGCCGCTGCTCCTGCTACTGGCCCT
GGGGCCTGGGGTGCAGGGCTGCCCATCCGGCTGCCAGTGCAGCCAGCCACAGACAGTCTTCT
GCACTGCCCGCCAGGGGACCACGGTGCCCCGAGACGTGCCACCCGACACGGTGGGGCTGTAC
GTCTTTGAGAACGGCATCACCATGCTCGACGCAAGCAGCTTTGCCGGCCTGCCGGGCCTGCA
GCTCCTGGACCTGTCACAGAACCAGATCGCCAGCCTGCGCCTGCCCCGCCTGCTGCTGCTGG
ACCTCAGCCACAACAGCCTCCTGGCCCTGGAGCCCGGCATCCTGGACACTGCCAACGTGGAG
GCGCTGCGGCTGGCTGGTCTGGGGCTGCAGCAGCTGGACGAGGGGCTCTTCAGCCGCTTGCG
CAACCTCCACGACCTGGATGTGTCCGACAACCAGCTGGAGCGAGTGCCACCTGTGATCCGAG
GCCTCCGGGGCCTGACGCGCCTGCGGCTGGCCGGCAACACCCGCATTGCCCAGCTGCGGCCC
GAGGACCTGGCCGGCCTGGCTGCCCTGCAGGAGCTGGATGTGAGCAACCTAAGCCTGCAGGC
CCTGCCTGGCGACCTCTCGGGCCTCTTCCCCGCCTGCGGCTGCTGGCAGCTGCCCGCAACC
CCTTCAACTGCGTGTGCCCCCTGAGCTGGTTTGGCCCTGGGTGCGCGAGAGCCACGTCACA
CTGGCCAGCCCTGAGGAGACGCGCTGCCACTTCCGCCCAAGAACGCTGGCCGGCTGCTCCT
GGAGCTTGACTACGCCGACTTTGGCTGCCCAGCCACCACCACCACAGCCACAGTGCCCACCA
CGAGGCCCGTGGTGCGGGAGCCCACAGCCTTGTCTTCTAGCTTGGCTCCTACCTGGCTTAGC
CCCACAGCGCCGGCCACTGAGGCCCCCAGCCCGCCCTCCACTGCCCCACCGACTGTAGGGCC
TGTCCCCCAGCCCCAGGACTGCCCACCGTCCACCTGCCTCAATGGGGGCACATGCCACCTGG
GGACACGGCACCACCTGGCGTGCTTGTGCCCCGAAGGCTTCACGGGCCTGTACTGTGAGAGC
CAGATGGGGCAGGGGACACGGCCCAGCCCTACACCAGTCACGCCGAGGCCACCACGGTCCCT
GACCCTGGGCATCGAGCCGGTGAGCCCCACCTCCCTGCGCGTGGGGCTGCAGCGCTACCTCC
AGGGGAGCTCCGTGCAGCTCAGGAGCCTCCGTCTCACCTATCGCAACCTATCGGGCCCTGAT
AAGCGGCTGGTGACGCTGCGACTGCCTGCCTCGCTCGCTGAGTACACGGTCACCCAGCTGCG
GCCCAACGCCACTTACTCCGTCTGTGTCATGCCTTTGGGGCCCGGGCGGGTGCCGGAGGGCG
AGGAGGCCTGCGGGGAGGCCCATACACCCCAGCCGTCCACTCCAACCACGCCCAGTCACC
CAGGCCCGCGAGGGCAACCTGCCGCTCCTCATTGCGCCCGCCCTGGCCGCGGTGCTCCTGGC
CGCGCTGGCTGCGGTGGGGGCAGCCTACTGTGTGCGGCGGGGCGGGCCATGGCAGCAGCGG
CTCAGGACAAAGGGCAGGTGGGGCCAGGGCTGGGCCCCTGGAACTGGAGGGAGTGAAGGTC
CCCTTGGAGCCAGGCCCGAAGGCAACAGAGGGCGGTGGAGAGGCCCTGCCCAGCGGGTCTGA
GTGTGAGGTGCCACTCATGGGCTTCCCAGGGCCTGGCCTCCAGTCACCCTCCACGCAAAGC
CCTACATCTAAGCCAGAGAGAGACAGGGCAGCTGGGCCGGGCTCTCAGCCAGTGAGATGGC
CAGCCCCTCCTGCTGCCACACCACGTAAGTTCTCAGTCCCAACCTCGGGGATGTGTGCAGA
CAGGGCTGTGTGACCACAGCTGGGCCCTGTTCCCTCTGGACCTCGGTCTCCTCATCTGTGAG
ATGCTGTGGCCCAGCTGACGAGCCCTAACGTCCCCAGAACCGAGTGCCTATGAGGACAGTGT
CCGCCCTGCCCTCCGCAACGTGCAGTCCCTGGGCACGGCGGGCCCTGCCATGTGCTGGTAAC
GCATGCCTGGGCCCTGCTGGGCTCTCCCACTCCAGGCGGACCCTGGGGCCAGTGAAGGAAG
CTCCCGGAAAGAGCAGAGGGAGAGCGGGTAGGCGGCTGTGTGACTCTAGTCTTGGCCCCAGG
AAGCGAAGGAACAAAAGAAACTGGAAAGGAAGATGCTTTAGGAACATGTTTTGCTTTTTTAA
AATATATATATATTTATAAGAGATCCTTTCCCATTTATTCTGGGAAGATGTTTTTCAAACTC
AGAGACAAGGACTTTGGTTTTTGTAAGACAAACGATGATATGAAGGCCTTTTGTAAGAAAAA
ATAAAAAAAAAAA
```

FIGURE 104

```
</usr/seqdb2/sst/DNA/Dnaseqs.min/ss.DNA44804
<subunit 1 of 1, 598 aa, 1 stop
<MW: 63030, pI: 7.24, NX(S/T): 3
MCSRVPLLLPLLLLLALGPGVQGCPSGCQCSQPQTVFCTARQGTTVPRDVPPDTVGLYVFEN
GITMLDASSFAGLPGLQLLDLSQNQIASLRLPRLLLLDLSHNSLLALEPGILDTANVEALRL
AGLGLQQLDEGLFSRLRNLHDLDVSDNQLERVPPVIRGLRGLTRLRLAGNTRIAQLRPEDLA
GLAALQELDVSNLSLQALPGDLSGLFPRLRLLAAARNPFNCVCPLSWFGPWVRESHVTLASP
EETRCHFPPKNAGRLLLELDYADFGCPATTTTATVPTTRPVVREPTALSSSLAPTWLSPTAP
ATEAPSPPSTAPPTVGPVPQPQDCPPSTCLNGGTCHLGTRHHLACLCPEGFTGLYCESQMGQ
GTRPSPTPVTPRPPRSLTLGIEPVSPTSLRVGLQRYLQGSSVQLRSLRLTYRNLSGPDKRLV
TLRLPASLAEYTVTQLRPNATYSVCVMPLGPGRVPEGEEACGEAHTPPAVHSNHAPVTQARE
GNLPLLIAPALAAVLLAALAAVGAAYCVRRGRAMAAAAQDKGQVGPGAGPLELEGVKVPLEP
GPKATEGGGEALPSGSECEVPLMGFPGPGLQSPLHAKPYI
```
Signal sequence.
amino acids 1-23
Transmembrane domain.
amino acids 501-522
N-glycosylation sites.
amino acids 198-202, 425-429, 453-457
Tyrosine kinase phosphorylation site.
amino acids 262-270
N-myristoylation sites.
amino acids 23-29, 27-33, 112-118, 273-279, 519-525, 565-571
Prokaryotic membrane lipoprotein lipid attachment site.
amino acids 14-25
EGF-like domain cysteine pattern signature.
amino acids 355-367
Leucine zipper pattern.
amino acids 122-144, 194-216

FIGURE 105

CCCACGCGTCCGAAGGCAGACAAAGGTTCATTTGTAAAGAAGCTCCTTCCAGCACCTCCTCT
CTTCTCCTTTTGCCCAAACTCACCCAGTGAGTGTGAGCATTTAAGAAGCATCCTCTGCCAAG
ACCAAAAGGAAAGAAGAAAAAGGGCCAAAAGCCAAAATGAAACTGATGGTACTTGTTTTCAC
CATTGGGCTAACTTTGCTGCTAGGAGTTCAAGCCATGCCTGCAAATCGCCTCTCTTGCTACA
GAAAGATACTAAAAGATCACAACTGTCACAACCTTCCGGAAGGAGTAGCTGACCTGACACAG
ATTGATGTCAATGTCCAGGATCATTTCTGGGATGGGAAGGGATGTGAGATGATCTGTTACTG
CAACTTCAGCGAATTGCTCTGCTGCCCAAAAGACGTTTTCTTTGGACCAAAGATCTCTTTCG
TGATTCCTTGCAACAATCAATGAGAATCTTCATGTATTCTGGAGAACACCATTCCTGATTTC
CCACAAACTGCACTACATCAGTATAACTGCATTTCTAGTTTCTATATAGTGCAATAGAGCAT
AGATTCTATAAATTCTTACTTGTCTAAGACAAGTAAATCTGTGTTAAACAAGTAGTAATAAA
AGTTAATTCAATCTAAAAAAAAAAAAA

FIGURE 106

```
</usr/seqdb2/sst/DNA/Dnaseqs.min/ss.DNA52758
<subunit 1 of 1, 98 aa, 1 stop
<MW: 11081, pI: 6.68, NX(S/T): 1
MKLMVLVFTIGLTLLLGVQAMPANRLSCYRKILKDHNCHNLPEGVADLTQIDVNVQDHFW
DGKGCEMICYCNFSELLCCPKDVFFGPKISFVIPCNNQ
```

Important features:
Signal peptide:
Amino acids     1-20

N-glycosylation site:
Amino acids     72-76

Tyrosine kinase phosphorylation site:
Amino acids     63-71

FIGURE 107

AGTGACTGCAGCCTTCCTAGATCCCCTCCACTCGGTTTCTCTCTTTGCAGGAGCACCGGCAG
CACCAGTGTGTGAGGGGAGCAGGCAGCGGTCCTAGCCAGTTCCTTGATCCTGCCAGACCACC
CAGCCCCCGGCACAGAGCTGCTCCACAGGCACCATGAGGATCATGCTGCTATTCACAGCCAT
CCTGGCCTTCAGCCTAGCTCAGAGCTTTGGGGCTGTCTGTAAGGAGCCACAGGAGGAGGTGG
TTCCTGGCGGGGCCGCAGCAAGAGGGATCCAGATCTCTACCAGCTGCTCCAGAGACTCTTC
AAAAGCCACTCATCTCTGGAGGGATTGCTCAAAGCCCTGAGCCAGGCTAGCACAGATCCTAA
GGAATCAACATCTCCCGAGAAACGTGACATGCATGACTTCTTTGTGGGACTTATGGGCAAGA
GGAGCGTCCAGCCAGAGGGAAAGACAGGACCTTTCTTACCTTCAGTGAGGGTTCCTCGGCCC
CTTCATCCCAATCAGCTTGGATCCACAGGAAAGTCTTCCCTGGGAACAGAGGAGCAGAGACC
TTTATAAGACTCTCCTACGGATGTGAATCAAGAGAACGTCCCCAGCTTTGGCATCCTCAAGTA
TCCCCCGAGAGCAGAATAGGTACTCCACTTCCGGACTCCTGGACTGCATTAGGAAGACCTCT
TTCCCTGTCCCAATCCCCAGGTGCGCACGCTCCTGTTACCCTTTCTCTTCCCTGTTCTTGTA
ACATTCTTGTGCTTTGACTCCTTCTCCATCTTTTCTACCTGACCCTGGTGTGGAAACTGCAT
AGTGAATATCCCCAACCCCAATGGGCATTGACTGTAGAATACCCTAGAGTTCCTGTAGTGTC
CTACATTAAAAATATAATGTCTCTCTCTATTCCTCAACAATAAAGGATTTTTGCATATGAAA
AAAAAAAAAAAAAAAAAAAAAAAAAAAAAAAAAAAAAAAA

FIGURE 108

```
</usr/seqdb2/sst/DNA/Dnaseqs.min/ss.DNA59849
<subunit 1 of 1, 135 aa, 1 stop
<MW: 14833, pI: 9.78, NX(S/T): 0
MRIMLLFTAILAFSLAQSFGAVCKEPQEEVVPGGGRSKRDPDLYQLLQRLFKSHSSLEGL
LKALSQASTDPKESTSPEKRDMHDFFVGLMGKRSVQPEGKTGPFLPSVRVPRPLHPNQLG
STGKSSLGTEEQRPL
```

Important features:
Signal peptide:
Amino acids 1-18

Tyrosine kinase phosphorylation site:
Amino acids 36-45

N-myristoylation sites:
Amino acids 33-39;59-65

Amidation site:
Amino acids 90-94

Leucine zipper pattern:
Amino acids 43-65

Tachykinin family signature:
Amino acids 86-92

FIGURE 109

GCGGCCACACGCAGCTAGCCGGAGCCCGGACCAGGCGCCTGTGCCTCCTCCTCGTCCCTCGC
CGCGTCCGCGAAGCCTGGAGCCGGCGGGAGCCCCGCGCTCGCCATGTCGGGCGAGCTCAGCA
ACAGGTTCCAAGGAGGGAAGGCGTTCGGCTTGCTCAAAGCCCGGCAGGAGAGGAGGCTGGCC
GAGATCAACCGGGAGTTTCTGTGTGACCAGAAGTACAGTGATGAAGAGAACCTTCCAGAAAA
GCTCACAGCCTTCAAAGAGAAGTACATGGAGTTTGACCTGAACAATGAAGGCGAGATTGACC
TGATGTCTTTAAAGAGGATGATGGAGAAGCTTGGTGTCCCCAAGACCCACCTGGAGATGAAG
AAGATGATCTCAGAGGTGACAGGAGGGGTCAGTGACACTATATCCTACCGAGACTTTGTGAA
CATGATGCTGGGGAAACGGTCGGCTGTCCTCAAGTTAGTCATGATGTTTGAAGGAAAAGCCA
ACGAGAGCAGCCCCAAGCCAGTTGGCCCCCCTCCAGAGAGAGACATTGCTAGCCTGCCCTGA
GGACCCCGCCTGGACTCCCCAGCCTTCCCACCCCATACCTCCCTCCCGATCTTGCTGCCCTT
CTTGACACACTGTGATCTCTCTCTCTCATTTGTTTGGTCATTGAGGGTTTGTTTGTGTTT
TCATCAATGTCTTTGTAAAGCACAAATTATCTGCCTTAAAGGGGCTCTGGGTCGGGGAATCC
TGAGCCTTGGGTCCCCTCCCTCTCTTCTTCCCTCCTTCCCCGCTCCCTGTGCAGAAGGGCTG
ATATCAAACCAAAAACTAGAGGGGGCAGGGCCAGGGCAGGGAGGCTTCCAGCCTGTGTTCCC
CTCACTTGGAGGAACCAGCACTCTCCATCCTTTCAGAAAGTCTCCAAGCCAAGTTCAGGCTC
ACTGACCTGGCTCTGACGAGGACCCCAGGCCACTCTGAGAAGACCTTGGAGTAGGGACAAGG
CTGCAGGGCCTCTTTCGGGTTTCCTTGGACAGTGCCATGGTTCCAGTGCTCTGGTGTCACCC
AGGACACAGCCACTCGGGGCCCCGCTGCCCCAGCTGATCCCCACTCATTCCACACCTCTTCT
CATCCTCAGTGATGTGAAGGTGGGAAGGAAAGGAGCTTGGCATTGGGAGCCCTTCAAGAAGG
TACCAGAAGGAACCCTCCAGTCCTGCTCTCTGGCCACACCTGTGCAGGCAGCTGAGAGGCAG
CGTGCAGCCCTACTGTCCCTTACTGGGGCAGCAGAGGGCTTCGGAGGCAGAAGTGAGGCCTG
GGGTTTGGGGGGAAAGGTCAGCTCAGTGCTGTTCCACCTTTTAGGGAGGATACTGAGGGGAC
CAGGATGGGAGAATGAGGAGTAAAATGCTCACGGCAAAGTCAGCAGCACTGGTAAGCCAAGA
CTGAGAAATACAAGGTTGCTTGTCTGACCCCAATCTGCTTGAAAAAAAAAAAAAAAAAA

FIGURE 110

MSGELSNRFQGGKAFGLLKARQERRLAEINREFLCDQKYSDEENLPEKLTAFKEKYMEFDLN
NEGEIDLMSLKRMMEKLGVPKTHLEMKKMISEVTGGVSDTISYRDFVNMMLGKRSAVLKLVM
MFEGKANESSPKPVGPPPERDIASLP

FIGURE 111

TAAAACAGCTACAATATTCCAGGGCCAGTCACTTGCCATTTCTCATAACAGCGTCAGAGAGA
AAGAACTGACTGAAACGTTTGAGATGAAGAAAGTTCTCCTCCTGATCACAGCCATCTTGGCA
GTGGCTGTTGGTTTCCCAGTCTCTCAAGACCAGGAACGAGAAAAAAGAAGTATCAGTGACAG
CGATGAATTAGCTTCAGGGTTTTTTGTGTTCCCTTACCCATATCCATTTCGCCCACTTCCAC
CAATTCCATTTCCAAGATTTCCATGGTTTAGACGTAATTTTCCTATTCCAATACCTGAATCT
GCCCCTACAACTCCCCTTCCTAGCGAAAAGTAAACAAGAAGGATAAGTCACGATAAACCTGG
TCACCTGAAATTGAAATTGAGCCACTTCCTTGAAGAATCAAAATTCCTGTTAATAAAAGAAA
AACAAATGTAATTGAAATAGCACACAGCATTCTCTAGTCAATATCTTTAGTGATCTTCTTTA
ATAAACATGAAAGCAAAGATTTTGGTTTCTTAATTTCCACA

FIGURE 112

```
></usr/seqdb2/sst/DNA/Dnaseqs.min/ss.DNA71290
><subunit 1 of 1, 85 aa, 1 stop
><MW: 9700, pI: 9.55, NX(S/T): 0
MKKVLLLITAILAVAVGFPVSQDQEREKRSISDSDELASGFFVFPYPYPFRPLPPIPFPR
FPWFRRNFPIPIPESAPTTPLPSEK
```

Important features of the protein:
Signal peptide:
Amino acids    1-17

Homologous region to B3-hordein:
Amino acids    47-85

FIGURE 113

CTCCTCTTAACATACTTGCAGCTAAAACTAAATATTGCTGCTTGGGGACCTCCTTCTAGCCT
TAAATTTCAGCTCATCACCTTCACCTGCCTTGGTCATGGCTCTGCTATTCTCCTTGATCCTT
GCCATTTGCACCAGACCTGGATTCCTAGCGTCTCCATCTGGAGTGCGGCTGGTGGGGGCCT
CCACCGCTGTGAAGGGCGGGTGGAGGTGGAACAGAAAGGCCAGTGGGGCACCGTGTGTGATG
ACGGCTGGGACATTAAGGACGTGGCTGTGTTGTGCCGGGAGCTGGGCTGTGGAGCTGCCAGC
GGAACCCCTAGTGGTATTTTGTATGAGCCACCAGCAGAAAAAGAGCAAAAGGTCCTCATCCA
ATCAGTCAGTTGCACAGGAACAGAAGATACATTGGCTCAGTGTGAGCAAGAAGAAGTTTATG
ATTGTTCACATGATGAAGATGCTGGGGCATCGTGTGAGAACCCAGAGAGCTCTTTCTCCCCA
GTCCCAGAGGGTGTCAGGCTGGCTGACGGCCCTGGGCATTGCAAGGGACGCGTGGAAGTGAA
GCACCAGAACCAGTGGTATACCGTGTGCCAGACAGGCTGGAGCCTCCGGGCCGCAAAGGTGG
TGTGCCGGCAGCTGGGATGTGGGAGGGCTGTACTGACTCAAAAACGCTGCAACAAGCATGCC
TATGGCCGAAAACCCATCTGGCTGAGCCAGATGTCATGCTCAGGACGAGAAGCAACCCTTCA
GGATTGCCCTTCTGGGCCTTGGGGGAAGAACACCTGCAACCATGATGAAGACACGTGGGTCG
AATGTGAAGATCCCTTTGACTTGAGACTAGTAGGAGGAGACAACCTCTGCTCTGGGCGACTG
GAGGTGCTGCACAAGGGCGTATGGGGCTCTGTCTGTGATGACAACTGGGGAGAAAAGGAGGA
CCAGGTGGTATGCAAGCAACTGGGCTGTGGGAAGTCCCTCTCTCCCTCCTTCAGAGACCGGA
AATGCTATGGCCCTGGGGTTGGCCGCATCTGGCTGGATAATGTTCGTTGCTCAGGGGAGGAG
CAGTCCCTGGAGCAGTGCCAGCACAGATTTGGGGGTTTCACGACTGCACCCACCAGGAAGA
TGTGGCTGTCATCTGCTCAGTGTAGGTGGGCATCATCTAATCTGTTGAGTGCCTGAATAGAA
GAAAAACACAGAAGAAGGGAGCATTTACTGTCTACATGACTGCATGGGATGAACACTGATCT
TCTTCTGCCCTTGGACTGGGACTTATACTTGGTGCCCCTGATTCTCAGGCCTTCAGAGTTGG
ATCAGAACTTACAACATCAGGTCTAGTTCTCAGGCCATCAGACATAGTTTGGAACTACATCA
CCACCTTTCCTATGTCTCCACATTGCACACAGCAGATTCCCAGCCTCCATAATTGTGTGTAT
CAACTACTTAAATACATTCTCACACACACACACACACACACACACACACACACACACACATA
CACCATTTGTCCTGTTTCTCTGAAGAACTCTGACAAAATACAGATTTTGGTACTGAAAGAGA
TTCTAGAGGAACGGAATTTTAAGGATAAATTTTCTGAATTGGTTATGGGGTTTCTGAAATTG
GCTCTATAATCTAATTAGATATAAAATTCTGGTAACTTTATTTACAATAATAAAGATAGCAC
TATGTGTTCAAA

FIGURE 114

MALLFSLILAICTRPGFLASPSGVRLVGGLHRCEGRVEVEQKGQWGTVCDDGWDIKDVAVLC
RELGCGAASGTPSGILYEPPAEKEQKVLIQSVSCTGTEDTLAQCEQEEVYDCSHDEDAGASC
ENPESSFSPVPEGVRLADGPGHCKGRVEVKHQNQWYTVCQTGWSLRAAKVVCRQLGCGRAVL
TQKRCNKHAYGRKPIWLSQMSCSGREATLQDCPSGPWGKNTCNHDEDTWVECEDPFDLRLVG
GDNLCSGRLEVLHKGVWGSVCDDNWGEKEDQVVCKQLGCGKSLSPSFRDRKCYGPGVGRIWL
DNVRCSGEEQSLEQCQHRFWGFHDCTHQEDVAVICSV

Signal sequence:
amino acids 1-15

Casein kinase II phosphorylation site.
amino acids 47-51, 97-101, 115-119, 209-213, 214-218, 234-238, 267-271, 294-298, 316-320, 336-340

N-myristoylation site.
amino acids 29-35, 43-49, 66-72, 68-74, 72-78, 98-104, 137-143, 180-186, 263-269, 286-292

Amidation site.
amino acids 196-200

Speract receptor repeated domain signature.
amino acids 29-67, 249-287

FIGURE 115

CATTTCCAACAAGAGCACTGGCCAAGTCAGCTTCTTCTGAGAGAGTCTCTAGAAGACATGAT
GCTACACTCAGCTTTGGGTCTCTGCCTCTTACTCGTCACAGTTTCTTCCAACCTTGCCATTG
CAATAAAAAAGGAAAAGAGGCCTCCTCAGACACTCTCAAGAGGATGGGGAGATGACATCACT
TGGGTACAAACTTATGAAGAAGGTCTCTTTTATGCTCAAAAAAGTAAGAAGCCATTAATGGT
TATTCATCACCTGGAGGATTGTCAATACTCTCAAGCACTAAAGAAAGTATTTGCCCAAAATG
AAGAAATACAAGAAATGGCTCAGAATAAGTTCATCATGCTAAACCTTATGCATGAAACCACT
GATAAGAATTTATCACCTGATGGGCAATATGTGCCTAGAATCATGTTTGTAGACCCTTCTTT
AACAGTTAGAGCTGACATAGCTGGAAGATACTCTAACAGATTGTACACATATGAGCCTCGGG
ATTTACCCCTATTGATAGAAAACATGAAGAAGCATTAAGACTTATTCAGTCAGAGCTATAA
GAGATGATGGAAAAAAGCCTTCACTTCAAAGAAGTCAAATTTCATGAAGAAAACCTCTGGCA
CATTGACAAATACTAAATGTGCAAGTATATAGATTTTGTAATATTACTATTTAGTTTTTTTA
ATGTGTTTGCAATAGTCTTATTAAAATAAATGTTTTTTAAATCTGA

FIGURE 116

</usr/seqdb2/sst/DNA/Dnaseqs.min/ss.DNA64896
<subunit 1 of 1, 166 aa, 1 stop
<MW: 19171, pI: 8.26, NX(S/T): 1
MMLHSALGLCLLLVTVSSNLAIAIKKEKRPPQTLSRGWGDDITWVQTYEEGLFYAQKSKK
PLMVIHHLEDCQYSQALKKVFAQNEEIQEMAQNKFIMLNLMHETTDKNLSPDGQYVPRIM
FVDPSLTVRADIAGRYSNRLYTYEPRDLPLLIENMKKALRLIQSEL

Important features:
Signal peptide:
Amino acids     1-23

N-myristoylation site:
Amino acids     51-57

FIGURE 117

```
CCTGGAGCCGGAAGCGCGGCTGCAGCAGGGCGAGGCTCCAGGTGGGGTCGGTTCCGCATCCA
GCCTAGCGTGTCCACGATGCGGCTGGGCTCCGGGACTTTCGCTACCTGTTGCGTAGCGATCG
AGGTGCTAGGGATCGCGGTCTTCCTTCGGGGATTCTTCCCGGCTCCCGTTCGTTCCTCTGCC
AGAGCGGAACACGGAGCGGAGCCCCCAGCGCCCGAACCCTCGGCTGGAGCCAGTTCTAACTG
GACCACGCTGCCACCACCTCTCTTCAGTAAAGTTGTTATTGTTCTGATAGATGCCTTGAGAG
ATGATTTTGTGTTTGGGTCAAAGGGTGTGAAATTTATGCCCTACACAACTTACCTTGTGGAA
AAAGGAGCATCTCACAGTTTTGTGGCTGAAGCAAAGCCACCTACAGTTACTATGCCTCGAAT
CAAGGCATTGATGACGGGGAGCCTTCCTGGCTTTGTCGACGTCATCAGGAACCTCAATTCTC
CTGCACTGCTGGAAGACAGTGTGATAAGACAAGCAAAAGCAGCTGGAAAAGAATAGTCTTT
TATGGAGATGAAACCTGGGTTAAATTATTCCCAAAGCATTTTGTGGAATATGATGGAACAAC
CTCATTTTTCGTGTCAGATTACACAGAGGTGGATAATAATGTCACGAGGCATTTGGATAAAG
TATTAAAAAGAGGAGATTGGGACATATTAATCCTCCACTACCTGGGGCTGGACCACATTGGC
CACATTTCAGGGCCCAACAGCCCCCTGATTGGGCAGAAGCTGAGCGAGATGGACAGCGTGCT
GATGAAGATCCACACCTCACTGCAGTCGAAGGAGAGAGAGACGCCTTTACCCAATTTGCTGG
TTCTTTGTGGTGACCATGGCATGTCTGAAACAGGAAGTCACGGGCCTCCTCCACCGAGGAG
GTGAATACACCTCTGATTTTAATCAGTTCTGCGTTTGAAAGGAAACCCGGTGATATCCGACA
TCCAAAGCACGTCCAATAGACGGATGTGGCTGCGACACTGGCGATAGCACTTGGCTTACCGA
TTCCAAAAGACAGTGTAGGGAGCCTCCTATTCCCAGTTGTGGAAGGAAGACCAATGAGAGAG
CAGTTGAGATTTTTACATTTGAATACAGTGCAGCTTAGTAAACTGTTGCAAGAGAATGTGCC
GTCATATGAAAAGATCCTGGGTTTGAGCAGTTTAAAATGTCAGAAAGATTGCATGGGAACT
GGATCAGACTGTACTTGGAGGAAAAGCATTCAGAAGTCCTATTCAACCTGGGCTCCAAGGTT
CTCAGGCAGTACCTGGATGCTCTGAAGACGCTGAGCTTGTCCCTGAGTGCACAAGTGGCCCA
GTTCTCACCCTGCTCCTGCTCAGCGTCCCACAGGCACTGCACAGAAAGGCTGAGCTGGAAGTC
CCACTGTCATCTCCTGGGTTTTCTCTGCTCTTTTATTTGGTGATCCTGGTTCTTTCGGCCGT
TCACGTCATTGTGTGCACCTCAGCTGAAAGTTCGTGCTACTTCTGTGGCCTCTCGTGGCTGG
CGGCAGGCTGCCTTTCGTTTACCAGACTCTGGTTGAACACCTGGTGTGTGCCAAGTGCTGGC
AGTGCCCTGGACAGGGGGCCTCAGGGAAGGACGTGGAGCAGCCTTATCCCAGGCCTCTGGGT
GTCCCGACACAGGTGTTCACATCTGTGCTGTCAGGTCAGATGCCTCAGTTCTTGGAAAGCTA
GGTTCCTGCGACTGTTACCAAGGTGATTGTAAAGAGCTGGCGGTCACAGAGGAACAAGCCCC
CCAGCTGAGGGGGTGTGTGAATCGGACAGCCTCCCAGCAGAGGTGTGGGAGCTGCAGCTGAG
GGAAGAAGAGACAATCGGCCTGGACACTCAGGAGGGTCAAAAGGAGACTTGGTCGCACCACT
CATCCTGCCACCCCAGAATGCATCCTGCCTCATCAGGTCCAGATTTCTTTCCAAGGCGGAC
GTTTTCTGTTGGAATTCTTAGTCCTTGGCCTCGGACACCTTCATTCGTTAGCTGGGGAGTGG
TGGTGAGGCAGTGAAGAAGAGGCGGATGGTCACACTCAGATCCACAGAGCCCAGGATCAAGG
GACCCACTGCAGTGGCAGCAGGACTGTTGGGCCCCACCCCAACCCTGCACAGCCCTCATCC
CCTCTTGGCTTGAGCCGTCAGAGGCCCTGTGCTGAGTGTCTGACCGAGACACTCACAGCTTT
GTCATCAGGGCACAGGCTTCCTCGGAGCCAGGATGATCTGTGCCACGCTTGCACCTCGGGCC
CATCTGGGCTCATGCTCTCTCCTGCTATTGAATTAGTACCTAGCTGCACACAGTATGTAG
TTACCAAAAGAATAAACGGCAATAATTGAGAAAAAAA
```

FIGURE 118

```
></usr/seqdb2/sst/DNA/Dnaseqs.min/ss.DNA84920
><subunit 1 of 1, 310 aa, 1 stop
><MW: 33875, pI: 7.08, NX(S/T): 2
MRLGSGTFATCCVAIEVLGIAVFLRGFFPAPVRSSARAEHGAEPPAPEPSAGASSNWTTL
PPPLFSKVVIVLIDALRDDFVFGSKGVKFMPYTTYLVEKGASHSFVAEAKPPTVTMPRIK
ALMTGSLPGFVDVIRNLNSPALLEDSVIRQAKAAGKRIVFYGDETWVKLFPKHFVEYDGT
TSFFVSDYTEVDNNVTRHLDKVLKRGDWDILILHYLGLDHIGHISGPNSPLIGQKLSEMD
SVLMKIHTSLQSKERETPLPNLLVLCGDHGMSETGSHGASSTEEVNTPLILISSAFERKP
GDIRHPKHVQ Important features of the protein:
Signal peptide:
Amino acids     1-34

Transmembrane domain:
Amino acids     58-76

N-glycosylation sites:
Amino acids     56-60;194-198

N-myristoylation sites:
Amino acids     6-12;52-58;100-106;125-131;233-239;270-276;
                275-281;278-284

Amidation site:
Amino acids     154-158

Cell attachment sequence:
Amino acids     205-208
```

FIGURE 119

GCCCACGCGTCCGATGGCGTTCACGTTCGCGGCCTTCTGCTACATGCTGGCGCTGCTGCTCA
CTGCCGCGCTCATCTTCTTCGCCATTTGGCACATTATAGCATTTGATGAGCTGAAGACTGAT
TACAAGAATCCTATAGACCAGTGTAATACCCTGAATCCCCTTGTACTCCCAGAGTACCTCAT
CCACGCTTTCTTCTGTGTCATGTTTCTTTGTGCAGCAGAGTGGCTTACACTGGGTCTCAATA
TGCCCCTCTTGGCATATCATATTTGGAGGTATATGAGTAGACCAGTGATGAGTGGCCCAGGA
CTCTATGACCCTACAACCATCATGAATGCAGATATTCTAGCATATTGTCAGAAGGAAGGATGG
TGCAAATTAGCTTTTTATCTTCTAGCATTTTTTACTACCTATATGGCATGATCTATGTTTT
GGTGAGCTCTTAGAACAACACACAGAAGAATTGGTCCAGTTAAGTGCATGCAAAAGCCACC
AAATGAAGGGATTCTATCCAGCAAGATCCTGTCCAAGAGTAGCCTGTGGAATCTGATCAGTT
ACTTTAAAAAATGACTCCTTATTTTTTAAATGTTTCCACATTTTTGCTTGTGGAAAGACTGT
TTTCATATGTTATACTCAGATAAAGATTTTAAATGGTATTACGTATAAATTAATATAAAATG
ATTACCTCTGGTGTTGACAGGTTTGAACTTGCACTTCTTAAGGAACAGCCATAATCCTCTGA
ATGATGCATTAATTACTGACTGTCCTAGTACATTGGAAGCTTTTGTTTATAGGAACTTGTAG
GGCTCATTTTGGTTTCATTGAAACAGTATCTAATTATAAATTAGCTGTAGATATCAGGTGCT
TCTGATGAAGTGAAAATGTATATCTGACTAGTGGGAAACTTCATGGGTTTCCTCATCTGTCA
TGTCGATGATTATATATGGATACATTTACAAAAATAAAAAGCGGGAATTTTCCCTTCGCTTG
AATATTATCCCTGTATATTGCATGAATGAGAGATTTCCCATATTTCCATCAGAGTAATAAAT
ATACTTGCTTTAATTCTTAAGCATAAGTAAACATGATATAAAAATATATGCTGAATTACTTG
TGAAGAATGCATTTAAAGCTATTTTAAATGTGTTTTTATTTGTAAGACATTACTTATTAAGA
AATTGGTTATTATGCTTACTGTTCTAATCTGGTGGTAAAGGTATTCTTAAGAATTTGCAGGT
ACTACAGATTTTCAAAACTGAATGAGAGAAAATTGTATAACCATCCTGCTGTTCCTTTAGTG
CAATACAATAAAACTCTGAAATTAAGACTC

FIGURE 120

```
</usr/seqdb2/sst/DNA/Dnaseqs.min/ss.DNA23330
<subunit 1 of 1, 144 aa, 1 stop
<MW: 16699, pI: 5.60, NX(S/T): 0
MAFTFAAFCYMLALLLTAALIFFAIWHIIAFDELKTDYKNPIDQCNTLNPLVLPEYLIHA
FFCVMFLCAAEWLTLGLNMPLLAYHIWRYMSRPVMSGPGLYDPTTIMNADILAYCQKEGW
CKLAFYLLAFFYYLYGMIYVLVSS
```

Important features:
Signal peptide:
Amino acids 1-20

Type II transmembrane domain:
Amino acids 11-31

Other transmembrane domain:
Amino acids 57-77;123-143

Glycosaminoglycan attachment site:
Amino acids 96-100

FIGURE 121

CGGACGCGTGGGCGGACGCGTGGGCGGCCCACGGCGCCCGCGGGCTGGGGCGGTCGCTTCTT
CCTTCTCCGTGGCCTACGAGGGTCCCCAGCCTGGGTAAAGATGGCCCCATGGCCCCCGAAGG
GCCTAGTCCCAGCTGTGCTCTGGGGCCTCAGCCTCTTCCTCAACCTCCCAGGACCTATCTGG
CTCCAGCCCTCTCCACCTCCCCAGTCTTCTCCCCGCCTCAGCCCCATCCGTGTCATACCTG
CCGGGGACTGGTTGACAGCTTTAACAAGGGCCTGGAGAGAACCATCCGGGACAACTTTGGAG
GTGGAAACACTGCCTGGGAGGAAGAGAATTTGTCCAAATACAAAGACAGTGAGACCCGCCTG
GTAGAGGTGCTGGAGGGTGTGTGCAGCAAGTCAGACTTCGAGTGCCACCGCCTGCTGGAGCT
GAGTGAGGAGCTGGTGGAGAGCTGGTGGTTTCACAAGCAGCAGGAGGCCCCGGACCTCTTCC
AGTGGCTGTGCTCAGATTCCCTGAAGCTCTGCTGCCCCGCAGGCACCTTCGGGCCCTCCTGC
CTTCCCTGTCCTGGGGGAACAGAGAGGCCCTGCGGTGGCTACGGGCAGTGTGAAGGAGAAGG
GACACGAGGGGGCAGCGGGCACTGTGACTGCCAAGCCGGCTACGGGGGTGAGGCCTGTGGCC
AGTGTGGCCTTGGCTACTTTGAGGCAGAACGCAACGCCAGCCATCTGGTATGTTCGGCTTGT
TTTGGCCCCTGTGCCCGATGCTCAGGACCTGAGGAATCAAACTGTTTGCAATGCAAGAAGGG
CTGGGCCCTGCATCACCTCAAGTGTGTAGACATTGATGAGTGTGGCACAGAGGGAGCCAACT
GTGGAGCTGACCAATTCTGCGTGAACACTGAGGGCTCCTATGAGTGCCGAGACTGTGCCAAG
GCCTGCCTAGGCTGCATGGGGGCAGGGCCAGGTCGCTGTAAGAAGTGTAGCCCTGGCTATCA
GCAGGTGGGCTCCAAGTGTCTCGATGTGGATGAGTGTGAGACAGAGGTGTGTCCGGGAGAGA
ACAAGCAGTGTGAAAACACCGAGGGCGGTTATCGCTGCATCTGTGCCGAGGGCTACAAGCAG
ATGGAAGGCATCTGTGTGAAGGAGCAGATCCCAGAGTCAGCAGGCTTCTTCTCAGAGATGAC
AGAAGACGAGTTGGTGGTGCTGCAGCAGATGTTCTTTGGCATCATCATCTGTGCACTGGCCA
CGCTGGCTGCTAAGGGCGACTTGGTGTTCACCGCCATCTTCATTGGGGCTGTGGCGGCCATG
ACTGGCTACTGGTTGTCAGAGCGCAGTGACCGTGTGCTGGAGGGCTTCATCAAGGGCAGA**TA
A**TCGCGGCCACCACCTGTAGGACCTCCTCCCACCCACGCTGCCCCAGAGCTTGGGCTGCCC
TCCTGCTGGACACTCAGGACAGCTTGGTTTATTTTTGAGAGTGGGGTAAGCACCCCTACCTG
CCTTACAGAGCAGCCCAGGTACCCAGGCCCGGGCAGACAAGGCCCTGGGGTAAAAAGTAGC
CCTGAAGGTGGATACCATGAGCTCTTCACCTGGCGGGGACTGGCAGGCTTCACAATGTGTGA
ATTTCAAAAGTTTTTCCTTAATGGTGGCTGCTAGAGCTTTGGCCCCTGCTTAGGATTAGGTG
GTCCTCACAGGGGTGGGGCCATCACAGCTCCCTCCTGCCAGCTGCATGCTGCCAGTTCCTGT
TCTGTGTTCACCACATCCCCACACCCCATTGCCACTTATTTATTCATCTCAGGAAATAAAGA
AAGGTCTTGGAAAGTTAAAAAAAAAAAAAAAAAAAAAAA

FIGURE 122

```
MAPWPPKGLVPAVLWGLSLFLNLPGPIWLQPSPPPQSSPPPQPHPCHTCRGLVDSFNKGLER
TIRDNFGGGNTAWEEENLSKYKDSETRLVEVLEGVCSKSDFECHRLLELSEELVESWWFHKQ
QEAPDLFQWLCSDSLKLCCPAGTFGPSCLPCPGGTERPCGGYGQCEGEGTRGGSGHCDCQAG
YGGEACGQCGLGYFEAERNASHLVCSACFGPCARCSGPEESNCLQCKKGWALHHLKCVDIDE
CGTEGANCGADQFCVNTEGSYECRDCAKACLGCMGAGPGRCKKCSPGYQQVGSKCLDVDECE
TEVCPGENKQCENTEGGYRCICAEGYKQMEGICVKEQIPESAGFFSEMTEDELVVLQQMFFG
IIICALATLAAKGDLVFTAIFIGAVAAMTGYWLSERSDRVLEGFIKGR
```

Important features:
Signal peptide:

Amino acids 1-29

Transmembrane domain:

Amino acids 342-392

N-glycosylation sites:

Amino acids 79-83;205-209 cAMP- and cGMP-dependent protein kinase phosphorylation site:
Amino acids 290-294

Aspartic acid and asparagine hydroxylation site:
Amino acids 321-333

EGF-like domain cysteine pattern signature:
Amino acids 181-193

FIGURE 123

```
GCAAGCCAAGGCGCTGTTTGAGAAGGTGAAGAAGTTCCGGACCCATGTGGAGGAGGGGGACATTGTGTACCGCC
TCTACATGCGGCAGACCATCATCAAGGTGATCAAGTTCATCCTCATCATCTGCTACACCGTCTACTACGTGCAC
AACATCAAGTTCGACGTGGACTGCACCGTGGACATTGAGAGCCTGACGGGCTACCGCACCTACCGCTGTGCCCA
CCCCCTGGCCACACTCTTCAAGATCCTGGCGTCCTTCTACATCAGCCTAGTCATCTTCTACGGCCTCATCTGCA
TGTACACACTGTGGTGGATGCTACGGCGCTCCCTCAAGAAGTACTCGTTTGAGTCGATCCGTGAGGAGAGCAGC
TACAGCGACATCCCCGACGTCAAGAACGACTTCGCCTTCATGCTGCACCTCATTGACCAATACGACCCGCTCTA
CTCCAAGCGCTTCGCCGTCTTCCTGTCGGAGGTGAGTGAGAACAAGCTGCGGCAGCTGAACCTCAACAACGAGT
GGACGCTGGACAAGCTCCGGCAGCGGCTCACCAAGAACGCGCAGGACAAGCTGGAGCTGCACCTGTTCATGCTC
AGTGGCATCCCTGACACTGTGTTTGACCTGGTGGAGCTGGAGGTCCTCAAGCTGGAGCTGATCCCCGACGTGAC
CATCCCGCCCAGCATTGCCCAGCTCACGGGCCTCAAGGAGCTGTGGCTCTACCACACAGCGGCCAAGATTGAAG
CGCCTGCGCTGGCCTTCCTGCGCGAGAACCTGCGGGCGCTGCACATCAAGTTCACCGACATCAAGGAGATCCCG
CTGTGGATCTATAGCCTGAAGACACTGGAGGAGCTGCACCTGACGGGCAACCTGAGCGCGGAGAACAACCGCTA
CATCGTCATCGACGGGCTGCGGGAGCTCAAACGCCTCAAGGTGCTGCGGCTCAAGAGCAACCTAAGCAAGCTGC
CACAGGTGGTCACAGATGTGGGCGTGCACCTGCAGAAGCTGTCCATCAACAATGAGGGCACCAAGCTCATCGTC
CTCAACAGCCTCAAGAAGATGGCGAACCTGACTGAGCTGGAGCTGATCCGCTGCGACCTGGAGCGCATCCCCCA
CTCCATCTTCAGCCTCCACAACCTGCAGGAGATTGACCTCAAGGACAACAACCTCAAGACCATCGAGGAGATCA
TCAGCTTCCAGCACCTGCACCGCCTCACCTGCCTTAAGCTGTGGTACAACCACATCGCCTACATCCCCATCCAG
ATCGGCAACCTCACCAACCTGGAGCGCCTCTACCTGAACCGCAACAAGATCGAGAAGATCCCCACCCAGCTCTT
CTACTGCCGCAAGCTGCGCTACCTGGACCTCAGCCACAACAACCTGACCTTCCTCCCTGCCGACATCGGCCTCC
TGCAGAACCTCCAGAACCTAGCCATCACGGCCAACCGGATCGAGACGCTCCCTCCGGAGCTCTTCCAGTGCCGG
AAGCTGCGGGCCCTGCACCTGGGCAACAACGTGCTGCAGTCACTGCCCTCCAGGGTGGGCGAGCTGACCAACCT
GACGCAGATCGAGCTGCGGGGCAACCGGCTGGAGTGCCTGCCTGTGGAGCTGGGCGAGTGCCCACTGCTCAAGC
GCAGCGGCTTGGTGGTGGAGGAGGACCTGTTCAACACACTGCCACCCGAGGTGAAGGAGCGGCTGTGGAGGGCT
GACAAGGAGCAGGCCTGAGCGAGGCCGGCCCAGCACAGCAAGCAGCAGGACCGCTGCCCAGTCCTCAGGCCCGG
AGGGGCAGGCCTAGCTTCTCCCAGAACTCCCGGACAGCCAGGACAGCCTCGCGGCTGGGCAGGAGCCTGGGGCC
GCTTGTGAGTCAGGCCAGAGCGAGAGGACAGTATCTGTGGGGCTGGCCCCTTTTCTCCCTCTGAGACTCACGTC
CCCCAGGGCAAGTGCTTGTGGAGGAGAGCAAGTCTCAAGAGCGCAGTATTTGGATAATCAGGGTCTCCTCCCTG
GAGGCCAGCTCTGCCCCAGGGGCTGAGCTGCCACCAGAGGTCCTGGGACCCTCACTTTAGTTCTTGGTATTTAT
TTTTCTCCATCTCCCACCTCCTTCATCCAGATAACTTATACATTCCCAAGAAAGTTCAGCCCAGATGGAAGGTG
TTCAGGGAAAGGTGGGCTGCCTTTTCCCCTTGTCCTTATTTAGCGATGCCGCCGGGCATTTAACACCCACCTGG
ACTTCAGCAGAGTGGTCCGGGGCGAACCAGCCAGTGGGACGGTCACCCAGCAGTGCCGGGCTGGGCTCTGCGGTG
CGGTCCACGGGAGAGCAGGCCTCCAGCTGGAAAGGCCAGGCCTGGAGCTTGCCTCTTCAGTTTTTGTGGCAGTT
TTAGTTTTTTGTTTTTTTTTTTTTAATCAAAAAACAATTTTTTTAAAAAAAAGCTTTGAAAATGGATGGTTT
GGGTATTAAAAAGAAAAAAAAAACTTAAAAAAAAAAAGACACTAACGGCCAGTGAGTTGGAGTCTCAGGGCAGG
GTGGCAGTTTCCCTTGAGCAAAGCAGCCAGACGTTGAACTGTGTTTCCTTTCCCTGGGCGCAGGGTGCAGGGTG
TCTTCCGGATCTGGTGTGACCTTGGTCCAGGAGTTCTATTTGTTCCTGGGGAGGGAGGTTTTTTTGTTTGTTTT
TTGGGTTTTTTGGTGTCTTGTTTTCTTTCTCCTCCATGTGTCTTGGCAGGCACTCATTTCTGTGGCTGTCGGC
CAGAGGGAATGTTCTGGAGCTGCCAAGGAGGGAGGAGACTCGGGTTGGCTAATCCCCGGATGAACGGTGCTCCA
TTCGCACCTCCCCTCCTCGTGCCTGCCCTGCCTCTCCACGCACAGTGTTAAGGAGCCAAGAGGAGCCACTTCGC
CCAGACTTTGTTTCCCCACCTCCTGCGGCATGGGTGTGTCCAGTGCCACCGCTGGCCTCCGCTGCTTCCATCAG
CCCTGTCGCCACCTGGTCCTTCATGAAGAGCAGACACTTAGAGGCTGGTCGGGAATGGGGAGGTCGCCCCTGGG
AGGGCAGGCGTTGGTTCCAAGCCGGTTCCCGTCCCTGGCGCCTGGAGTGCACACAGCCCAGTCGGCACCTGGTG
GCTGGAAGCCAACCTGCTTTAGATCACTCGGGTCCCCACCTTAGAAGGGTCCCCGCCTTAGATCAATCACGTGG
ACACTAAGGCACGTTTTAGAGTCTCTTGTCTTAATGATTATGTCCATCCGTCTGTCCGTCCATTTGTGTTTTCT
GCGTCGTGTCATTGGATATAATCCTCAGAAATAATGCACACTAGCCTCTGACAACCATGAAGCAAAAATCCGTT
ACATGTGGGTCTGAACTTGTAGACTCGGTCACAGTATCAAATAAAATCTATAACAGAAAAAAAAAAAAAAA
```

FIGURE 124

MRQTIIKVIKFILIICYTVYYVHNIKFDVDCTVDIESLTGYRTYRCAHPLATLFKILASFYI
SLVIFYGLICMYTLWWMLRRSLKKYSFESIREESSYSDIPDVKNDFAFMLHLIDQYDPLYSK
RFAVFLSEVSENKLRQLNLNNEWTLDKLRQRLTKNAQDKLELHLFMLSGIPDTVFDLVELEV
LKLELIPDVTIPPSIAQLTGLKELWLYHTAAKIEAPALAFLRENLRALHIKFTDIKEIPLWI
YSLKTLEELHLTGNLSAENNRYIVIDGLRELKRLKVLRLKSNLSKLPQVVTDVGVHLQKLSI
NNEGTKLIVLNSLKKMANLTELELIRCDLERIPHSIFSLHNLQEIDLKDNNLKTIEEIISFQ
HLHRLTCLKLWYNHIAYIPIQIGNLTNLERLYLNRNKIEKIPTQLFYCRKLRYLDLSHNNLT
FLPADIGLLQNLQNLAITANRIETLPPELFQCRKLRALHLGNNVLQSLPSRVGELTNLTQIE
LRGNRLECLPVELGECPLLKRSGLVVEEDLFNTLPPEVKERLWRADKEQA

Transmembrane domain:
amino acids 51-75 (type II)

N-glycosylation site.
amino acids 262-266, 290-294, 328-332, 396-400, 432-436, 491-495 cAMP- and cGMP-dependent protein kinase phosphorylation site.
amino acids 85-89

Casein kinase II phosphorylation site.
amino acids 91-95, 97-101, 177-181, 253-257, 330-334, 364-368, 398-402, 493-497

N-myristoylation site.
amino acids 173-179, 261-267, 395-401, 441-447

FIGURE 125

```
GTTGTGTCCTTCAGCAAAACAGTGGATTTAAATCTCCTTGCACAAGCTTGAGAGCAACACAA
TCTATCAGGAAAGAAAGAAAGAAAAAAACCGAACCTGACAAAAAAGAAGAAAAAGAAGAAGA
AAAAAAATCATGAAAACCATCCAGCCAAAAATGCACAATTCTATCTCTTGGGCAATCTTCAC
GGGGCTGGCTGCTCTGTGTCTCTTCCAAGGAGTGCCCGTGCGCAGCGGAGATGCCACCTTCC
CCAAAGCTATGGACAACGTGACGGTCCGGCAGGGGGAGAGCGCCACCCTCAGGTGCACTATT
GACAACGGGTCACCCGGGTGGCCTGGCTAAACCGCAGCACCATCCTCTATGCTGGGAATGA
CAAGTGGTGCCTGGATCCTCGCGTGGTCCTTCTGAGCAACACCCAAACGCAGTACAGCATCG
AGATCCAGAACGTGGATGTGTATGACGAGGGCCCTTACACCTGCTCGGTGCAGACAGACAAC
CACCCAAAGACCTCTAGGGTCCACCTCATTGTGCAAGTATCTCCCAAAATTGTAGAGATTTC
TTCAGATATCTCCATTAATGAAGGGAACAATATTAGCCTCACCTGCATAGCAACTGGTAGAC
CAGAGCCTACGGTTACTTGGAGACACATCTCTCCCAAAGCGGTTGGCTTTGTGAGTGAAGAC
GAATACTTGGAAATTCAGGGCATCACCCGGGAGCAGTCAGGGGACTACGAGTGCAGTGCCTC
CAATGACGTGGCCGCGCCCGTGGTACGGAGAGTAAAGGTCACCGTGAACTATCCACCATACA
TTTCAGAAGCCAAGGGTACAGGTGTCCCCGTGGGACAAAAGGGGACACTGCAGTGTGAAGCC
TCAGCAGTCCCCTCAGCAGAATTCCAGTGGTACAAGGATGACAAAAGACTGATTGAAGGAAA
GAAAGGGGTGAAAGTGGAAAACAGACCTTTCCTCTCAAAACTCATCTTCTTCAATGTCTCTG
AACATGACTATGGGAACTACACTTGCGTGGCCTCCAACAAGCTGGGCCACACCAATGCCAGC
ATCATGCTATTTGGTCCAGGCGCCGTCAGCGAGGTGAGCAACGGCACGTCGAGGAGGGCAGG
CTGCGTCTGGCTGCTGCCTCTTCTGGTCTTGCACCTGCTTCTCAAATTTTGATGTGAGTGCC
ACTTCCCCACCCGGGAAAGGCTGCCGCCACCACCACCACCAACACAACAGCAATGGCAACAC
CGACAGCAACCAATCAGATATATACAAATGAAATTAGAAGAAACACAGCCTCATGGGACAGA
AATTTGAGGGAGGGGAACAAAGAATACTTTGGGGGGAAAAGAGTTTTAAAAAAGAAATTGAA
AATTGCCTTGCAGATATTTAGGTACAATGGAGTTTTCTTTTCCCAAACGGGAAGAACACAGC
ACACCCGGCTTGGACCCACTGCAAGCTGCATCGTGCAACCTCTTTGGTGCCAGTGTGGGCAA
GGGCTCAGCCTCTCTGCCCACAGAGTGCCCCACGTGGAACATTCTGGAGCTGGCCATCCCA
AATTCAATCAGTCCATAGAGACGAACAGAATGAGACCTTCCGGCCCAAGCGTGGCGCTGCGG
GCACTTTGGTAGACTGTGCCACCACGGCGTGTGTTGTGAAACGTGAAATAAAAGAGCAAAA
AAAAA
```

FIGURE 126

MKTIQPKMHNSISWAIFTGLAALCLFQGVPVRSGDATFPKAMDNVTVRQGESATLRCTIDNR
VTRVAWLNRSTILYAGNDKWCLDPRVVLLSNTQTQYSIEIQNVDVYDEGPYTCSVQTDNHPK
TSRVHLIVQVSPKIVEISSDISINEGNNISLTCIATGRPEPTVTWRHISPKAVGFVSEDEYL
EIQGITREQSGDYECSASNDVAAPVVRRVKVTVNYPPYISEAKGTGVPVGQKGTLQCEASAV
PSAEFQWYKDDKRLIEGKKGVKVENRPFLSKLIFFNVSEHDYGNYTCVASNKLGHTNASIML
FGPGAVSEVSNGTSRRAGCVWLLPLLVLHLLLKF

Important features:
Signal peptide:
amino acids 1-28

FIGURE 127

```
GGCGCCGGTGCACCGGGCGGGCTGAGCGCCTCCTGCGGCCCGGCCTGCGCGCCCCGGCCCGCCGCGCCGCCCAC
GCCCCAACCCCGGCCCGCGCCCCCTAGCCCCCGCCCGGGCCCGCGCCCGCGCCCGCGCCCAGGTGAGCGCTCCG
CCCGCCGCGAGGCCCCGCCCCGGCCCGCCCCGCCCCGCCCCGGCCGGCGGGGGAACCGGGCGGATTCCTCGCG
CGTCAAACCACCTGATCCCATAAAACATTCATCCTCCCGGCGGCCCGCGCTGCGAGCGCCCCGCCAGTCCGCGC
CGCCGCCGCCCTCGCCCTGTGCGCCCTGCGCGCCCTGCGCACCCGCGGCCCGAGCCCAGCCAGAGCCGGGCGGA
GCGGAGCGCGCCGAGCCTCGTCCCGCGGCCGGGCCGGGGCCGGGCCGTAGCGGCGGCGCCTGGATGCGGACCCG
GCCGCGGGGAGACGGGCGCCCGCCCCGAAACGACTTTCAGTCCCCGACGCGCCCCGCCCAACCCCTACGATGAA
GAGGGCGTCCGCTGGAGGGAGCCGGCTGCTGGCATGGGTGCTGTGGCTGCAGGCCTGGCAGGTGGCAGCCCCAT
GCCCAGGTGCCTGCGTATGCTACAATGAGCCCAAGGTGACGACAAGCTGCCCCCAGCAGGGCCTGCAGGCTGTG
CCCGTGGGCATCCCTGCTGCCAGCCAGCGCATCTTCCTGCACGGCAACCGCATCTCGCATGTGCCAGCTGCCAG
CTTCCGTGCCTGCCGCAACCTCACCATCCTGTGGCTGCACTCGAATGTGCTGGCCCGAATTGATGCGGCTGCCT
TCACTGGCCTGGCCCTCCTGGAGCAGCTGGACCTCAGCGATAATGCACAGCTCCGGTCTGTGGACCCTGCCACA
TTCCACGGCCTGGGCCGCCTACACACGCTGCACCTGGACCGCTGCGGCCTGCAGGAGCTGGGCCCGGGGCTGTT
CCGCGGCCTGGCTGCCCTGCAGTACCTCTACCTGCAGGACAACGCGCTGCAGGCACTGCCTGATGACACCTTCC
GCGACCTGGGCAACCTCACACACCTCTTCCTGCACGGCAACCGCATCTCCAGCGTGCCCGAGCGCGCCTTCCGT
GGGCTGCACAGCCTCGACCGTCTCCTACTGCACCAGAACCGCGTGGCCCATGTGCACCCGCATGCCTTCCGTGA
CCTTGGCCGCCTCATGACACTCTATCTGTTTGCCAACAATCTATCAGCGCTGCCCACTGAGGCCCTGGCCCCCC
TGCGTGCCCTGCAGTACCTGAGGCTCAACGACAACCCCTGGGTGTGTGACTGCCGGGCACGCCCACTCTGGGCC
TGGCTGCAGAAGTTCCGCGGCTCCTCCTCCGAGGTGCCCTGCAGCCTCCCGCAACGCCTGGCTGGCCGTGACCT
CAAACGCCTAGCTGCCAATGACCTGCAGGGCTGCGCTGTGGCCACCGGCCCTTACCATCCCATCTGGACCGGCA
GGGCCACCGATGAGGAGCCGCTGGGGCTTCCCAAGTGCTGCCAGCCAGATGCCGCTGACAAGGCCTCAGTACTG
GAGCCTGGAAGACCAGCTTCGGCAGGCAATGCGCTGAAGGGACGCGTGCCGCCCGGTGACAGCCCGCCGGGCAA
CGGCTCTGGCCCACGGCACATCAATGACTCACCCTTTGGGACTCTGCCTGGCTCTGCTGAGCCCCGCTCACTG
CAGTGCGGCCCGAGGGCTCCGAGCCACCAGGGTTCCCCACCTCGGGCCCTCGCCGGAGGCCAGGCTGTTCACGC
AAGAACCGCACCCGCAGCCACTGCCGTCTGGGCCAGGCAGGCAGCGGGGGTGGCGGGACTGGTGACTCAGAAGG
CTCAGGTGCCCTACCCAGCCTCACCTGCAGCCTCACCCCCTGGGCCTGGCGCTGGTGCTGTGGACAGTGCTTG
GGCCCTGCTGACCCCCAGCGGACACAAGAGCGTGCTCAGCAGCCAGGTGTGTGTACATACGGGGTCTCTCTCCA
CGCCGCCAAGCCAGCCGGGCGGCCGACCCGTGGGGCAGGCCAGGCCAGGTCCTCCCTGATGGACGCCTGCCGCC
CGCCACCCCCATCTCCACCCCATCATGTTTACAGGGTTCGGCGGCAGCGTTTGTTCCAGAACGCCGCCTCCCAC
CCAGATCGCGGTATATAGAGATATGCATTTTATTTTACTTGTGTAAAAATATCGGACGACGTGGAATAAAGAGC
TCTTTTCTTAAAAAAA
```

FIGURE 128

MKRASAGGSRLLAWVLWLQAWQVAAPCPGACVCYNEPKVTTSCPQQGLQAVPVGIPAASQRIFLHGNRISHVPA
ASFRACRNLTILWLHSNVLARIDAAAFTGLALLEQLDLSDNAQLRSVDPATFHGLGRLHTLHLDRCGLQELGPG
LFRGLAALQYLYLQDNALQALPDDTFRDLGNLTHLFLHGNRISSVPERAFRGLHSLDRLLLHQNRVAHVHPHAF
RDLGRLMTLYLFANNLSALPTEALAPLRALQYLRLNDNPWVCDCRARPLWAWLQKFRGSSSEVPCSLPQRLAGR
DLKRLAANDLQGCAVATGPYHPIWTGRATDEEPLGLPKCCQPDAADKASVLEPGRPASAGNALKGRVPPGDSPP
GNGSGPRHINDSPFGTLPGSAEPPLTAVRPEGSEPPGFPTSGPRRRPGCSRKNRTRSHCRLGQAGSGGGGTGDS
EGSGALPSLTCSLTPLGLALVLWTVLGPC

Important features:
Signal peptide:
amino acids 1-26

Leucine zipper pattern.
amino acids 135-156

Glycosaminoglycan attachment site.
amino acids 436-439

N-glycosylation site.
amino acids 82-85, 179-183, 237-240, 372-375 and 423-426

VWFC domain
amino acids 411-425

FIGURE 129

```
GCGCCGGGAGCCCATCTGCCCCCAGGGGCACGGGGCGCGGGGCCGGCTCCCGCCCGGCACATGGCTGCAGCCAC
CTCGCGCGCACCCCGAGGCGCCGCGCCCAGCTCGCCCGAGGTCCGTCGGAGGCGCCCGGCCGCCCCGGAGCCAA
GCAGCAACTGAGCGGGGAAGCGCCCGCGTCCGGGGATCGGGATGTCCCTCCTCCTTCTCCTCTTGCTAGTTTCC
TACTATGTTGGAACCTTGGGGACTCACACTGAGATCAAGAGAGTGGCAGAGGAAAAGGTCACTTTGCCCTGCCA
CCATCAACTGGGGCTTCCAGAAAAAGACACTCTGGATATTGAATGGCTGCTCACCGATAATGAAGGGAACCAAA
AAGTGGTGATCACTTACTCCAGTCGTCATGTCTACAATAACTTGACTGAGGAACAGAAGGGCCGAGTGGCCTTT
GCTTCCAATTTCCTGGCAGGAGATGCCTCCTTGCAGATTGAACCTCTGAAGCCCAGTGATGAGGGCCGGTACAC
CTGTAAGGTTAAGAATTCAGGGCGCTACGTGTGGAGCCATGTCATCTTAAAAGTCTTAGTGAGACCATCCAAGC
CCAAGTGTGAGTTGGAAGGAGAGCTGACAGAAGGAAGTGACCTGACTTTGCAGTGTGAGTCATCCTCTGGCACA
GAGCCCATTGTGTATTACTGGCAGCGAATCCGAGAGAAAGAGGGAGAGGATGAACGTCTGCCTCCCAAATCTAG
GATTGACTACAACCACCCTGGACGAGTTCTGCTGCAGAATCTTACCATGTCCTACTCTGGACTGTACCAGTGCA
CAGCAGGCAACGAAGCTGGGAAGGAAAGCTGTGTGGTGCGAGTAACTGTACAGTATGTACAAAGCATCGGCATG
GTTGCAGGAGCAGTGACAGGCATAGTGGCTGGAGCCCTGCTGATTTTCCTCTTGGTGTGGCTGCTAATCCGAAG
GAAAGACAAAGAAAGATATGAGGAAGAAGAGAGACCTAATGAAATTCGAGAAGATGCTGAAGCTCCAAAAGCCC
GTCTTGTGAAACCCAGCTCCTCTTCCTCAGGCTCTCGGAGCTCACGCTCTGGTTCTTCCTCCACTCGCTCCACA
GCAAATAGTGCCTCACGCAGCCAGCGGACACTGTCAACTGACGCAGCACCCCAGCCAGGGCTGGCCACCCAGGC
ATACAGCCTAGTGGGGCCAGAGGTGAGAGGTTCTGAACCAAAGAAAGTCCACCATGCTAATCTGACCAAAGCAG
AAACCACACCCAGCATGATCCCCAGCCAGAGCAGAGCCTTCCAAACGGTCTGAATTACAATGGACTTGACTCCC
ACGCTTTCCTAGGAGTCAGGGTCTTTGGACTCTTCTCGTCATTGGAGCTCAAGTCACCAGCCACACAACCAGAT
GAGAGGTCATCTAAGTAGCAGTGAGCATTGCACGGAACAGATTCAGATGAGCATTTTCCTTATACAATACCAAA
CAAGCAAAAGGATGTAAGCTGATTCATCTGTAAAAAGGCATCTTATTGTGCCTTTAGACCAGAGTAAGGGAAAG
CAGGAGTCCAAATCTATTTGTTGACCAGGACCTGTGGTGAGAAGGTTGGGGAAAGGTGAGGTGAATATACCTAA
AACTTTTAATGTGGGATATTTTGTATCAGTGCTTTGATTCACAATTTTCAAGAGGAAATGGGATGCTGTTTGTA
AATTTTCTATGCATTTCTGCAAACTTATTGGATTATTAGTTATTCAGACAGTCAAGCAGAACCCACAGCCTTAT
TACACCTGTCTACACCATGTACTGAGCTAACCACTTCTAAGAAACTCCAAAAAAGGAAACATGTGTCTTCTATT
CTGACTTAACTTCATTTGTCATAAGGTTTGGATATTAATTTCAAGGGGAGTTGAAATAGTGGGAGATGGAGAAG
AGTGAATGAGTTTCTCCCACTCTATACTAATCTCACTATTTGTATTGAGCCCAAAATAACTATGAAAGGAGACA
AAAATTTGTGACAAAGGATTGTGAAGAGCTTTCCATCTTCATGATGTTATGAGGATTGTTGACAAACATTAGAA
ATATATAATGGAGCAATTGTGGATTTCCCCTCAAATCAGATGCCTCTAAGGACTTTCCTGCTAGATATTTCTGG
AAGGAGAAAATACAACATGTCATTTATCAACGTCCTTAGAAAGAATTCTTCTAGAGAAAAAGGGATCTAGGAAT
GCTGAAAGATTACCCAACATACCATTATAGTCTCTTCTTTCTGAGAAAATGTGAAACCAGAATTGCAAGACTGG
GTGGACTAGAAAGGGAGATTAGATCAGTTTTCTCTTAATATGTCAAGGAAGGTAGCCGGGCATGGTGCCAGGCA
CCTGTAGGAAAATCCAGCAGGTGGAGGTTGCAGTGAGCCGAGATTATGCCATTGCACTCCAGCCTGGGTGACAG
AGCGGGACTCCGTCTC
```

FIGURE 130

MSLLLLLLLVSYYVGTLGTHTEIKRVAEEKVTLPCHHQLGLPEKDTLDIEWLLTDNEGNQKVVITYSSRHVYNN
LTEEQKGRVAFASNFLAGDASLQIEPLKPSDEGRYTCKVKNSGRYVWSHVILKVLVRPSKPKCELEGELTEGSD
LTLQCESSSGTEPIVYYWQRIREKEGEDERLPPKSRIDYNHPGRVLLQNLTMSYSGLYQCTAGNEAGKESCVVR
VTVQYVQSIGMVAGAVTGIVAGALLIFLLVWLLIRRKDKERYEEEERPNEIREDAEAPKARLVKPSSSSSGSRS
SRSGSSSTRSTANSASRSQRTLSTDAAPQPGLATQAYSLVGPEVRGSEPKKVHHANLTKAETTPSMIPSQSRAFQTV

Important freatures:
Signal sequence:
amino acids 1-16

Transmembrane domain:
amino acids 232-251

FIGURE 131

```
GGAAGTCCACGGGGAGCTTGGATGCCAAAGGGAGGACGGCTGGGTCCTCTGGAGAGGACTAC
TCACTGGCATATTTCTGAGGTATCTGTAGAATAACCACAGCCTCAGATACTGGGGACTTTAC
AGTCCCACAGAACCGTCCTCCCAGGAAGCTGAATCCAGCAAGAACAATGGAGGCCAGCGGGA
AGCTCATTTGCAGACAAAGGCAAGTCCTTTTTTCCTTTCTCCTTTTGGGCTTATCTCTGGCG
GGCGCGGCGGAACCTAGAAGCTATTCTGTGGTGGAGGAAACTGAGGCAGCTCCTTTGTCAC
CAATTTAGCAAAGGACCTGGGTCTGGAGCAGAGGGAATTCTCCAGGCGGGGGGTTAGGGTTG
TTTCCAGAGGGAACAAACTACATTTGCAGCTCAATCAGGAGACCGCGGATTTGTTGCTAAAT
GAGAAATTGGACCGTGAGGATCTGTGCGGTCACACAGAGCCCTGTGTGCTACGTTTCCAAGT
GTTGCTAGAGAGTCCCTTCGAGTTTTTTCAAGCTGAGCTGCAAGTAATAGACATAAACGACC
ACTCTCCAGTATTTCTGGACAAACAAATGTTGGTGAAAGTATCAGAGAGCAGTCCTCCTGGG
ACTACGTTTCCTCTGAAGAATGCCGAAGACTTAGATGTAGGCCAAAACAATATTGAGAACTA
TATAATCAGCCCCAACTCCTATTTTCGGGTCCTCACCCGCAAACGCAGTGATGGCAGGAAAT
ACCCAGAGCTGGTGCTGGACAAAGCGCTGGACCGAGAGGAAGAAGCTGAGCTCAGGTTAACA
CTCACAGCACTGGATGGTGGCTCTCCGCCCAGATCTGGCACTGCTCAGGTCTACATCGAAGT
CCTGGATGTCAACGATAATGCCCCTGAATTTGAGCAGCCTTTCTATAGAGTGCAGATCTCTG
AGGACAGTCCGGTAGGCTTCCTGGTTGTGAAGGTCTCTGCCACGGATGTAGACACAGGAGTC
AACGGAGAGATTTCCTATTCACTTTTCCAAGCTTCAGAAGAGATTGGCAAAACCTTTAAGAT
CAATCCCTTGACAGGAGAAATTGAACTAAAAAAACAACTCGATTTCGAAAAACTTCAGTCCT
ATGAAGTCAATATTGAGGCAAGAGATGCTGGAACCTTTTCTGGAAAATGCACCGTTCTGATT
CAAGTGATAGATGTGAACGACCATGCCCCAGAAGTTACCATGTCTGCATTTACCAGCCCAAT
ACCTGAGAACGCGCCTGAAACTGTGGTTGCACTTTTCAGTGTTTCAGATCTTGATTCAGGAG
AAAATGGGAAAATTAGTTGCTCCATTCAGGAGGATCTACCCTTCCTCCTGAAATCCGCGGAA
AACTTTTACACCCTACTAACGGAGAGACCACTAGACAGAGAAAGCAGAGCGGAATACAACAT
CACTATCACTGTCACTGACTTGGGGACCCCTATGCTGATAACACAGCTCAATATGACCGTGC
TGATCGCCGATGTCAATGACAACGCTCCCGCCTTCACCCAAACCTCCTACACCCTGTTCGTC
CGCGAGAACAACAGCCCCGCCCTGCACATCCGCAGCGTCAGCGCTACAGACAGAGACTCAGG
CACCAACGCCCAGGTCACCTACTCGCTGCTGCCGCCCCAGGACCCGCACCTGCCCCTCACAT
CCCTGGTCTCCATCAACGCGGACAACGGCCACCTGTTCGCCCTCAGGTCTCTGGACTACGAG
GCCCTGCAGGGGTTCCAGTTCCGCGTGGGCGCTTCAGACCACGGCTCCCGGCGCTGAGCAG
CGAGGCGCTGGTGCGCGTGGTGGTGCTGGACGCCAACGACAACTCGCCCTTCGTGCTGTACC
CGCTGCAGAACGGCTCCGCGCCCTGCACCGAGCTGGTGCCCCGGGCGGCCGAGCCGGGCTAC
CTGGTGACCAAGGTGGTGGCGGTGGACGGCGACTCGGGCCAGAACGCCTGGCTGTCGTACCA
GCTGCTCAAGGCCACGGAGCTCGGTCTGTTCGGCGTGTGGGCGCACAATGGCGAGGTGCGCA
CCGCCAGGCTGCTGAGCGAGCGCGACGCGGCCAAGCACAGGCTGGTGGTGCTGGTCAAGGAC
AATGGCGAGCCTCCGCGCTCGGCCACCGCCACGCTGCACGTGCTCCTGGTGGACGGCTTCTC
CCAGCCCTACCTGCCTCTCCCGGAGGCGGCCCCGACCCAGGCCCAGGCCGACTTGCTCACCG
TCTACCTGGTGGTGGCGTTGGCCTCGGTGTCTTCGCTCTTCCTCTTTTCGGTGCTCCTGTTC
GTGGCGGTGCCGCTGTGTAGGAGGAGCAGGGCGGCCTCGGTGGGTCGCTGCTTGGTGCCCGA
GGGCCCCCTTCCAGGGCATCTTGTGGACATGAGCGGCACCAGGACCCTATCCCAGAGCTACC
AGTATGAGGTGTGTCTGGCAGGAGGCTCAGGGACCAATGAGTTCAAGTTCCTGAAGCCGATT
ATCCCCAACTTCCCTCCCCAGTGCCCTGGGAAAGAAATACAAGGAAATTCTACCTTCCCCAA
TAACTTTGGGTTCAATATTCAGTGACCATAGTTGACTTTTACATTCCATAGGTATTTTATTT
TGTGGCATTTCCATGCCAATGTTTATTTCCCCCAATTTGTGTGTATGTAATATTGTACGGAT
TTACTCTTGATTTTTCTCATGTTCTTTCTCCCTTTGTTTTAAAGTGAACATTTACCTTTATT
CCTGGTTCTT
```

FIGURE 132

```
</usr/seqdb2/sst/DNA/Dnaseqs.min/ss.DNA48314
<subunit 1 of 1, 798 aa, 1 stop
<MW: 87552, pI: 4.84, NX(S/T): 5
MEASGKLICRQRQVLFSFLLLGLSLAGAAEPRSYSVVEETEGSSFVTNLAKDLGLEQREFSR
RGVRVVSRGNKLHLQLNQETADLLLNEKLDREDLCGHTEPCVLRFQVLLESPFEFFQAELQV
IDINDHSPVFLDKQMLVKVSESSPPGTTFPLKNAEDLDVGQNNIENYIISPNSYFRVLTRKR
SDGRKYPELVLDKALDREEEAELRLTLTALDGGSPPRSGTAQVYIEVLDVNDNAPEFEQPFY
RVQISEDSPVGFLVVKVSATDVDTGVNGEISYSLFQASEEIGKTFKINPLTGEIELKKQLDF
EKLQSYEVNIEARDAGTFSGKCTVLIQVIDVNDHAPEVTMSAFTSPIPENAPETVVALFSVS
DLDSGENGKISCSIQEDLPFLLKSAENFYTLLTERPLDRESRAEYNITITVTDLGTPMLITQ
LNMTVLIADVNDNAPAFTQTSYTLFVRENNSPALHIRSVSATDRDSGTNAQVTYSLLPPQDP
HLPLTSLVSINADNGHLFALRSLDYEALQGFQFRVGASDHGSPALSSEALVRVVVLDANDNS
PFVLYPLQNGSAPCTELVPRAAEPGYLVTKVVAVDGDSGQNAWLSYQLLKATELGLFGVWAH
NGEVRTARLLSERDAAKHRLVVLVKDNGEPPRSATATLHVLLVDGFSQPYLPLPEAAPTQAQ
ADLLTVYLVVALASVSSLFLFSVLLFVAVRLCRRSRAASVGRCLVPEGPLPGHLVDMSGTRT
LSQSYQYEVCLAGGSGTNEFKFLKPIIPNFPPQCPGKEIQGNSTFPNNFGFNIQ
```

Important features:
Signal peptide:
amino acids 1-26

Transmembrane domain:
amino acids 685-712

Cadherins extracellular repeated domain signature.
amino acids 122-132, 231-241, 336-346, 439-449 and 549-559

ATP/GTP-binding site motif A (P-loop).
amino acids 285-292

N-glycosylation site.
amino acids 418-421, 436-439, 567-570 and 786-789

FIGURE 133

```
GGAAGGGGAGGAGCAGGCCACACAGGCACAGGCCGGTGAGGGACCTGCCCAGACCTGGAGGGTCTCGCTCTGTC
ACACAGGCTGGAGTGCAGTGGTGTGATCTTGGCTCATCGTAACCTCCACCTCCCGGGTTCAAGTGATTCTCATG
CCTCAGCCTCCCGAGTAGCTGGGATTACAGGTGGTGACTTCCAAGAGTGACTCCGTCGGAGGAAATGACTCCC
CAGTCGCTGCTGCAGACGACACTGTTCCTGCTGAGTCTGCTCTTCCTGGTCCAAGGTGCCCACGGCAGGGGCCA
CAGGGAAGACTTTCGCTTCTGCAGCCAGCGGAACCAGACACACAGGAGCAGCCTCCACTACAAACCCACACCAG
ACCTGCGCATCTCCATCGAGAACTCCGAAGAGGCCCTCACAGTCCATGCCCCTTTCCCTGCAGCCCACCCTGCT
TCCCGATCCTTCCCTGACCCCAGGGGCCTCTACCACTTCTGCCTCTACTGGAACCGACATGCTGGGAGATTACA
TCTTCTCTATGGCAAGCGTGACTTCTTGCTGAGTGACAAAGCCTCTAGCCTCCTCTGCTTCCAGCACCAGGAGG
AGAGCCTGGCTCAGGGCCCCCCGCTGTTAGCCACTTCTGTCACCTCCTGGTGGAGCCCTCAGAACATCAGCCTG
CCCAGTGCCGCCAGCTTCACCTTCTCCTTCCACAGTCCTCCCCACACGGCCGCTCACAATGCCTCGGTGGACAT
GTGCGAGCTCAAAAGGGACCTCCAGCTGCTCAGCCAGTTCCTGAAGCATCCCCAGAAGGCCTCAAGGAGGCCCT
CGGCTGCCCCCGCCAGCCAGCAGTTGCAGAGCCTGGAGTCGAAACTGACCTCTGTGAGATTCATGGGGGACATG
GTGTCCTTCGAGGAGGACCGGATCAACGCCACGGTGTGGAAGCTCCAGCCCACAGCCGGCCTCCAGGACCTGCA
CATCCACTCCCGGCAGGAGGAGGAGCAGAGCGAGATCATGGAGTACTCGGTGCTGCTGCCTCGAACACTCTTCC
AGAGGACGAAAGGCCGGAGCGGGGAGGCTGAGAAGAGACTCCTCCTGGTGGACTTCAGCAGCCAAGCCCTGTTC
CAGGACAAGAATTCCAGCCAAGTCCTGGGTGAGAAGGTCTTGGGGATTGTGGTACAGAACACCAAAGTAGCCAA
CCTCACGGAGCCCGTGGTGCTCACTTTCCAGCACCAGCTACAGCCGAAGAATGTGACTCTGCAATGTGTTCT
GGGTTGAAGACCCCACATTGAGCAGCCCGGGGCATTGGAGCAGTGCTGGGTGTGAGACCGTCAGGAGAGAAACC
CAAACATCCTGCTTCTGCAACCACTTGACCTACTTTGCAGTGCTGATGGTCTCCTCGGTGGAGGTGGACGCCGT
GCACAAGCACTACCTGAGCCTCCTCTCCTACGTGGGCTGTGTCGTCTCTGCCCTGGCCTGCCTTGTCACCATTG
CCGCCTACCTCTGCTCCAGGGTGCCCCTGCCGTGCAGGAGGAAACCTCGGGACTACACCATCAAGGTGCACATG
AACCTGCTGCTGGCCGTCTTCCTGCTGGACACGAGCTTCCTGCTCAGCGAGCCGGTGGCCCTGACAGGCTCTGA
GGCTGGCTGCCGAGCCAGTGCCATCTTCCTGCACTTCTCCCTGCTCACCTGCCTTTCCTGGATGGGCCTCGAGG
GGTACAACCTCTACCGACTCGTGGTGGAGGTCTTTGGCACCTATGTCCCTGGCTACCTACTCAAGCTGAGCGCC
ATGGGCTGGGGCTTCCCCATCTTTCTGGTGACGCTGGTGGCCCTGGTGGATGTGGACAACTATGGCCCCATCAT
CTTGGCTGTGCATAGGACTCCAGAGGGCGTCATCTACCCTTCCATGTGCTGGATCCGGGACTCCCTGGTCAGCT
ACATCACCAACCTGGGCCTCTTCAGCCTGGTGTTTCTGTTCAACATGGCCATGCTAGCCACCATGGTGGTGCAG
ATCCTGCGGCTGCGCCCCCACACCCAAAAGTGGTCACATGTGCTGACACTGCTGGGCCTCAGCCTGGTCCTTGG
CCTGCCCTGGGCCTTGATCTTCTTCTCCTTTGCTTCTGGCACCTTCCAGCTTGTCGTCCTCTACCTTTTCAGCA
TCATCACCTCCTTCCAAGGCTTCCTCATCTTCATCTGGTACTGGTCCATGCGGCTGCAGGCCCGGGGTGGCCCC
TCCCCTCTGAAGAGCAACTCAGACAGCGCCAGGCTCCCCATCAGCTCGGGCAGCACCTCGTCCAGCCGCATCTA
GGCCTCCAGCCCACCTGCCCATGTGATGAAGCAGAGATGCGGCCTCGTCGCACACTGCCTGTGGCCCCCGAGCC
AGGCCCAGCCCCAGGCCAGTCAGCCGCAGACTTTGGAAAGCCCAACGACCATGGAGAGATGGGCCGTTGCCATG
GTGGACGGACTCCCGGGCTGGGCTTTTGAATTGGCCTTGGGGACTACTCGGCTCTCACTCAGCTCCCACGGGAC
TCAGAAGTGCGCCGCCATGCTGCCTAGGGTACTGTCCCCACATCTGTCCCAACCCAGCTGGAGGCCTGGTCTCT
CCTTACAACCCCTGGGCCCAGCCCTCATTGCTGGGGGCCAGGCCTTGGATCTTGAGGGTCTGGCACATCCTTAA
TCCTGTGCCCCTGCCTGGGACAGAAATGTGGCTCCAGTTGCTCTGTCTCTCGTGGTCACCCTGAGGGCACTCTG
CATCCTCTGTCATTTTAACCTCAGGTGGCACCCAGGGCGAATGGGGCCCAGGGCAGACCTTCAGGGCCAGAGCC
CTGGCGGAGGAGAGGCCCTTTGCCAGGAGCACAGCAGCAGCTCGCCTACCTCTGAGCCCAGGCCCCCTCCCTCC
CTCAGCCCCCCAGTCCTCCCTCCATCTTCCCTGGGGTTCTCCTCCTCTCCCAGGGCCTCCTTGCTCCTTCGTTC
ACAGCTGGGGGTCCCCGATTCCAATGCTGTTTTTTGGGGAGTGGTTTCCAGGAGCTGCCTGGTGTCTGCTGTAA
ATGTTTGTCTACTGCACAAGCCTCGGCCTGCCCCTGAGCCAGGCTCGGTACCGATGCGTGGGCTGGGCTAGGTC
CCTCTGTCCATCTGGGCCTTTGTATGAGCTGCATTGCCCTTGCTCACCCTGACCAAGCACACGCCTCAGAGGGG
CCCTCAGCCTCTCCTGAAGCCCTCTTGTGGCAAGAACTGTGGACCATGCCAGTCCCGTCTGGTTTCCATCCCAC
CACTCCAAGGACTGAGACTGACCTCCTCTGGTGACACTGGCCTAGAGCCTGACACTCTCCTAAGAGGTTCTCTC
CAAGCCCCCAAATAGCTCCAGGCGCCCTCGGCCGCCCATCATGGTTAATTCTGTCCAACAAACACACACGGGTA
GATTGCTGGCCTGTTGTAGGTGGTAGGGACACAGATGACCGACCTGGTCACTCCTCCTGCCAACATTCAGTCTG
GTATGTGAGGCGTGCGTGAAGCAAGAACTCCTGGAGCTACAGGGACAGGGAGCCATCATTCCTGCCTGGGAATC
CTGGAAGACTTCCTGCAGGAGTCAGCGTTCAATCTTGACCTTGAAGATGGGAAGGATGTTCTTTTTACGTACCA
ATTCTTTTGTCTTTTGATATTAAAAAGAAGTACATGTTCATTGTAGAGAATTTGGAAACTGTAGAAGAGAATCA
AGAAGAAAAATAAAAATCAGCTGTTGTAATCGCCTAGCAAAAAAAAAAAAAAAAAAAAAAAAAAAAAAAAAAAA
AAAAAAAAAAAAAAAAAAAAAAAAAAAAAAAAAAAAAAAAA
```

FIGURE 134

MTPQSLLQTTLFLLSLLFLVQGAHGRGHREDFRFCSQRNQTHRSSLHYKPTPDLRISIENSE
EALTVHAPFPAAHPASRSFPDPRGLYHFCLYWNRHAGRLHLLYGKRDFLLSDKASSLLCFQH
QEESLAQGPPLLATSVTSWWSPQNISLPSAASFTFSFHSPPHTAAHNASVDMCELKRDLQLL
SQFLKHPQKASRRPSAAPASQQLQSLESKLTSVRFMGDMVSFEEDRINATVWKLQPTAGLQD
LHIHSRQEEEQSEIMEYSVLLPRTLFQRTKGRSGEAEKRLLLVDFSSQALFQDKNSSQVLGE
KVLGIVVQNTKVANLTEPVVLTFQHQLQPKNVTLQCVFWVEDPTLSSPGHWSSAGCETVRRF
TQTSCFCNHLTYFAVLMVSSVEVDAVHKHYLSLLSYVGCVVSALACLVTIAAYLCSRVPLPC
RRKPRDYTIKVHMNLLLAVFLLDTSFLLSEPVALTGSEAGCRASAIFLHFSLLTCLSWMGLE
GYNLYRLVVEVFGTYVPGYLLKLSAMGWGFPIFLVTLVALVDVDNYGPIILAVHRTPEGVIY
PSMCWIRDSLVSYITNLGLFSLVFLFNMAMLATMVVQILRLRPHTQKWSHVLTLLGLSVLG
LPWALIFFSFASGTFQLVVLYLFSIITSFQGFLIFIWYWSMRLQARGGPSPLKSNSDSARLP
ISSGSTSSSRI

Important features:
Signal peptide:
amino acids 1-25
Putative transmembrane domains:
amino acids 382-398, 402-420, 445-468, 473-491, 519-537, 568-590
and 634-657
Microbodies C-terminal targeting signal.
amino acids 691-693
cAMP- and cGMP-dependent protein kinase phosphorylation sites.
amino acids 198-201 and 370-373
N-glycosylation sites.
amino acids 39-42, 148-151, 171-174, 234-237, 303-306, 324-327
and 341-344
G-protein coupled receptors family 2 proteins
amino acids 475-504

FIGURE 135

```
GCCTAGCCAGGCCAAGAATGCAATTGCCCCGGTGGTGGGAGCTGGGAGACCCCTGTGCTTGGACGGGACAGGGTCGG
GGGACACGCAGGATGAGCCCCGCGACCACTGGCACATTCTTGCTCACAGTGTACAGTATTTTCTCCAAGGTACA
CTCCGATCGGAATGTATACCCATCAGCAGGTGTCCTCTTTGTTCATGTTTTGGAAAGAGAATATTTTAAGGGGG
AATTTCCACCTTACCCAAAACCTGGCGAGATTAGTAATGATCCCATAACATTTAATACAAATTTAATGGGTTAC
CCAGACCGACCTGGATGGCTTCGATATATCCAAAGGACACCATATAGTGATGGAGTCCTATATGGGTCCCCAAC
AGCTGAAAATGTGGGGAAGCCAACAATCATTGAGATAACTGCCTACAACAGGCGCACCTTTGAGACTGCAAGGC
ATAATTTGATAATTAATATAATGTCTGCAGAAGACTTCCCGTTGCCATATCAAGCAGAATTCTTCATTAAGAAT
ATGAATGTAGAAGAAATGTTGGCCAGTGAGGTTCTTGGAGACTTTCTTGGCGCAGTGAAAAATGTGTGGCAGCC
AGAGCGCCTGAACGCCATAAACATCACATCGGCCCTAGACAGGGGTGGCAGGGTGCCACTTCCCATTAATGACC
TGAAGGAGGGCGTTTATGTCATGGTTGGTGCAGATGTCCCGTTTTCTTCTTGTTTACGAGAAGTTGAAAATCCA
CAGAATCAATTGAGATGTAGTCAAGAAATGGAGCCTGTAATAACATGTGATAAAAATTTCGTACTCAATTTTA
CATTGACTGGTGCAAAATTTCATTGGTTGATAAAACAAAGCAAGTGTCCACCTATCAGGAAGTGATTCGTGGAG
AGGGGATTTTACCTGATGGTGGAGAATACAAACCCCCTTCTGATTCTTTGAAAAGCAGAGACTATTACACGGAT
TTCCTAATTACACTGGCTGTGCCCTCGGCAGTGGCACTGGTCCTTTTTCTAATACTTGCTTATATCATGTGCTG
CCGACGGGAAGGCGTGGAAAAGAGAAACATGCAAACACCAGACATCCAACTGGTCCATCACAGTGCTATTCAGA
AATCTACCAAGGAGCTTCGAGACATGTCCAAGAATAGAGAGATAGCATGGCCCCTGTCAACGCTTCCTGTGTTC
CACCCTGTGACTGGGGAAATCATACCTCCTTTACACACAGACAACTATGATAGCACAAACATGCCATTGATGCA
AACGCAGCAGAACTTGCCCACATCAGACTCAGATTCCCCAACAGCAGACTACAGGTAAATGGTATCCCTGAAGAA
AGAAAACTGACTGAAGCAATGAATTTATAATCAGACAATATAGCAGTTACATCACATTTCTTTTCTCTTCCAAT
AATGCATGAGCTTTTCTGGCATATGTTATGCATGTTGGCAGTATTAAGTGTATACCAAATAATACAACATAACT
TTCATTTTACTAATGTATTTTTTTGTACTTAAAGCATTTTTGACAATTTGTAAAACATTGATGACTTTATATTT
GTTACAATAAAAGTTGATCTTTAAAATAAATATTATTAATGAAGCCTAAAAAAAAAAA
```

FIGURE 136

```
MQLPRWWELGDPCAWTGQGRGTRRMSPATTGTFLLTVYSIFSKVHSDRNVYPSAGVLFVHVLEREYFKGEFPPY
PKPGEISNDPITFNTNLMGYPDRPGWLRYIQRTPYSDGVLYGSPTAENVGKPTIIEITAYNRRTFETARHNLII
NIMSAEDFPLPYQAEFFIKNMNVEEMLASEVLGDFLGAVKNVWQPERLNAINITSALDRGGRVPLPINDLKEGV
YVMVGADVPFSSCLREVENPQNQLRCSQEMEPVITCDKKFRTQFYIDWCKISLVDKTKQVSTYQEVIRGEGILP
DGGEYKPPSDSLKSRDYYTDFLITLAVPSAVALVLFLILAYIMCCRREGVEKRNMQTPDIQLVHHSAIQKSTKE
LRDMSKNREIAWPLSTLPVFHPVTGEIIPPLHTDNYDSTNMPLMQTQQNLPHQTQIPQQQTTGKWYP
``` signal sequence:
Amino acids 1-46 transmembrane domain:
Amino acids 319-338

N-glycosylation site:
Amino acids 200-204 cAMP- and cGMP-dependent protein kinase phosphorylation site:
Amino acids 23-27

Tyrosine kinase phosphorylation site:
Amino acids 43-52

N-myristoylation sites:
Amino acids 17-23;112-118;116-122;

```
CAGAAGAGGGGGCTAGCTAGCTGTCTCTGCGGACCAGGGAGACCCCCGCGCCCCCCGGTGT
GAGGCGGCCTCACAGGGCCGGGTGGGCTGGCGAGCCGACGCGGCGGCGGAGGAGGCTGTGAG
GAGTGTGTGGAACAGGACCCGGGACAGAGGAACCATGGCTCCGCAGAACCTGAGCACCTTTT
GCCTGTTGCTGCTATACCTCATCGGGGCGGTGATTGCCGGACGAGATTTCTATAAGATCTTG
GGGGTGCCTCGAAGTGCCTCTATAAAGGATATTAAAAAGGCCTATAGGAAACTAGCCCTGCA
GCTTCATCCCGACCGGAACCCTGATGATCCACAAGCCCAGGAGAAATTCCAGGATCTGGGTG
CTGCTTATGAGGTTCTGTCAGATAGTGAGAAACGGAAACAGTACGATACTTATGGTGAAGAA
GGATTAAAAGATGGTCATCAGAGCTCCCATGGAGACATTTTTTCACACTTCTTTGGGGATTT
TGGTTTCATGTTTGGAGGAACCCCTCGTCAGCAAGACAGAAATATTCCAAGAGGAAGTGATA
TTATTGTAGATCTAGAAGTCACTTTGGAAGAAGTATATGCAGGAAATTTTGTGGAAGTAGTT
AGAAACAAACCTGTGGCAAGGCAGGCTCCTGGCAAACGGAAGTGCAATTGTCGGCAAGAGAT
GCGGACCACCCAGCTGGGCCCTGGGCGCTTCCAAATGACCCAGGAGGTGGTCTGCGACGAAT
GCCCTAATGTCAAACTAGTGAATGAAGAACGAACGCTGGAAGTAGAAATAGAGCCTGGGGTG
AGAGACGGCATGGAGTACCCCTTTATTGGAGAAGGTGAGCCTCACGTGGATGGGGAGCCTGG
AGATTTACGGTTCCGAATCAAAGTTGTCAAGCACCCAATATTTGAAAGGAGAGGAGATGATT
TGTACACAAATGTGACAATCTCATTAGTTGAGTCACTGGTTGGCTTTGAGATGGATATTACT
CACTTGGATGGTCACAAGGTACATATTTCCCGGGATAAGATCACCAGGCCAGGAGCGAAGCT
ATGGAAGAAAGGGGAAGGGCTCCCCAACTTTGACAACAACAATATCAAGGGCTCTTTGATAA
TCACTTTTGATGTGGATTTTCCAAAAGAACAGTTAACAGAGGAAGCGAGAGAAGGTATCAAA
CAGCTACTGAAACAAGGGTCAGTGCAGAAGGTATACAATGGACTGCAAGGATATTGAGAGTG
AATAAAATTGGACTTTGTTTAAAATAAGTGAATAAGCGATATTTATTATCTGCAAGGTTTTT
TTGTGTGTGTTTTTGTTTTTATTTTCAATATGCAAGTTAGGCTTAATTTTTTTATCTAATGA
TCATCATGAAATGAATAAGAGGGCTTAAGAATTTGTCCATTTGCATTCGGAAAAGAATGACC
AGCAAAAGGTTTACTAATACCTCTCCCTTTGGGGATTTAATGTCTGGTGCTGCCGCCTGAGT
TTCAAGAATTAAAGCTGCAAGAGGACTCCAGGAGCAAAAGAAACACAATATAGAGGGTTGGA
GTTGTTAGCAATTTCATTCAAAATGCCAACTGGAGAAGTCTGTTTTTAAATACATTTTGTTG
TTATTTTTA
```

FIGURE 138

MAPQNLSTFCLLLLYLIGAVIAGRDFYKILGVPRSASIKDIKKAYRKLALQLHPDRNPDDPQAQEKFQDLGAAY
EVLSDSEKRKQYDTYGEEGLKDGHQSSHGDIFSHFFGDFGFMFGGTPRQQDRNIPRGSDIIVDLEVTLEEVYAG
NFVEVVRNKPVARQAPGKRKCNCRQEMRTTQLGPGRFQMTQEVVCDECPNVKLVNEERTLEVEIEPGVRDGMEY
PFIGEGEPHVDGEPGDLRFRIKVVKHPIFERRGDDLYTNVTISLVESLVGFEMDITHLDGHKVHISRDKITRPG
AKLWKKGEGLPNFDNNNIKGSLIITFDVDFPKEQLTEEAREGIKQLLKQGSVQKVYNGLQGY

Important features:
Signal peptide:
amino acids 1-22

Cell attachment sequence.
amino acids 254-257

Nt-dnaJ domain signature.
amino acids 67-87

Homologous region to Nt-dnaJ domain proteins.
amino acids 26-58

N-glycosylation site.
amino acids 5-9, 261-265

Tyrosine kinase phosphorylation site.
amino acids 253-260

N-myristoylation site.
amino acids 18-24, 31-37, 93-99, 215-221

Amidation site.
amino acids 164-168

FIGURE 139

```
CCAGTCTGTCGCCACCTCACTTGGTGTCTGCTGTCCCCGCCAGGCAAGCCTGGGGTGAGAGC
ACAGAGGAGTGGGCCGGGACCATGCGGGGACGCGGCTGGCGCTCCTGGCGCTGGTGCTGGC
TGCCTGCGGAGAGCTGGCGCCGGCCCTGCGCTGCTACGTCTGTCCGGAGCCCACAGGAGTGT
CGGACTGTGTCACCATCGCCACCTGCACCACCAACGAAACCATGTGCAAGACCACACTCTAC
TCCCGGGAGATAGTGTACCCCTTCCAGGGGGACTCCACGGTGACCAAGTCCTGTGCCAGCAA
GTGTAAGCCCTCGGATGTGGATGGCATCGGCCAGACCCTGCCCGTGTCCTGCTGCAATACTG
AGCTGTGCAATGTAGACGGGGCGCCCGCTCTGAACAGCCTCCACTGCGGGGCCCTCACGCTC
CTCCCACTCTTGAGCCTCCGACTGTAGAGTCCCCGCCCACCCCATGGCCCTATGCGGCCCA
GCCCCGAATGCCTTGAAGAAGTGCCCCCTGCACCAGGAAAAAAAAAAAAAAAAA
```

FIGURE 140

```
</usr/seqdb2/sst/DNA/Dnaseqs.min/ss.DNA56405
<subunit 1 of 1, 125 aa, 1 stop
<MW: 13115, pI: 5.90, NX(S/T): 1
MRGTRLALLALVLAACGELAPALRCYVCPEPTGVSDCVTIATCTTNETMCKTTLYSREIVYP
FQGDSTVTKSCASKCKPSDVDGIGQTLPVSCCNTELCNVDGAPALNSLHCGALTLLPLLSLRL
```

Important features:
Signal peptide:
amino acids 1-17

N-glycosylation site.
amino acids 46-49

FIGURE 141

```
GGCGCCGCGTAGGCCCGGGAGGCCGGGCCGGCCGGGCTGCGAGCGCCTGCCCCATGCGCCGC
CGCCTCTCCGCACGATGTTCCCCTCGCGGAGGAAAGCGGCGCAGCTGCCCTGGGAGGACGGC
AGGTCCGGGTTGCTCTCCGGCGGCCTCCCTCGGAAGTGTTCCGTCTTCCACCTGTTCGTGGC
CTGCCTCTCGCTGGGCTTCTTCTCCCTACTCTGGCTGCAGCTCAGCTGCTCTGGGGACGTGG
CCCGGGCAGTCAGGGACAAGGGCAGGAGACCTCGGGCCCTCCCCGTGCCTGCCCCCAGAG
CCGCCCCTGAGCACTGGGAAGAAGACGCATCCTGGGGCCCCACCGCCTGGCAGTGCTGGT
GCCCTTCCGCGAACGCTTCGAGGAGCTCCTGGTCTTCGTGCCCACATGCGCCGCTTCCTGA
GCAGGAAGAAGATCCGGCACCACATCTACGTGCTCAACCAGGTGGACCACTTCAGGTTCAAC
CGGGCAGCGCTCATCAACGTGGGCTTCCTGGAGAGCAGCAACAGCACGGACTACATTGCCAT
GCACGACGTTGACCTGCTCCCTCTCAACGAGGAGCTGGACTATGGCTTTCCTGAGGCTGGGC
CCTTCCACGTGGCCTCCCCGGAGCTCCACCCTCTCTACCACTACAAGACCTATGTCGGCGGC
ATCCTGCTGCTCTCCAAGCAGCACTACCGGCTGTGCAATGGGATGTCCAACCGCTTCTGGGG
CTGGGGCCGCGAGGACGACGAGTTCTACCGGCGCATTAAGGGAGCTGGGCTCCAGCTTTTCC
GCCCCTCGGGAATCACAACTGGGTACAAGACATTTCGCCACCTGCATGACCCAGCCTGGCGG
AAGAGGGACCAGAAGCGCATCGCAGCTCAAAAACAGGAGCAGTTCAAGGTGGACAGGGAGGG
AGGCCTGAACACTGTGAAGTACCATGTGGCTTCCCGCACTGCCCTGTCTGTGGGCGGGGCCC
CCTGCACTGTCCTCAACATCATGTTGGACTGTGACAAGACCGCCACACCCTGGTGCACATTC
AGCTGAGCTGGATGGACAGTGAGGAAGCCTGTACCTACAGGCCATATTGCTCAGGCTCAGGA
CAAGGCCTCAGGTCGTGGGCCCAGCTCTGACAGGATGTGGAGTGGCCAGGACCAAGACAGCA
AGCTACGCAATTGCAGCCACCCGGCCGCCAAGGCAGGCTTGGGCTGGGCCAGGACACGTGGG
GTGCCTGGGACGCTGCTTGCCATGCACAGTGATCAGAGAGAGGCTGGGGTGTGTCCTGTCCG
GGACCCCCCTGCCTTCCTGGTCACCCTACTCTGACCTCCTTCACGTGCCCAGGCCTGTGGG
TAGTGGGGAGGGCTGAACAGGACAACCTCTCATCACCCTACTCTGACCTCCTTCACGTGCCC
AGGCCTGTGGGTAGTGGGGAGGGCTGAACAGGACAACCTCTCATCACCCCAAAAAAAAAA
AAAAAAAAAAAAAAAAAAAAAAAAAAAAAAAAAA
```

FIGURE 142

```
></usr/seqdb2/sst/DNA/Dnaseqs.min/ss.DNA56531
><subunit 1 of 1, 327 aa, 1 stop
><MW: 37406, pI: 9.30, NX(S/T): 1
MFPSRRKAAQLPWEDGRSGLLSGGLPRKCSVFHLFVACLSLGFFSLLWLQLSCSGDVARAVR
GQGQETSGPPRACPPEPPPEHWEEDASWGPHRLAVLVPFRERFEELLVFVPHMRRFLSRKKI
RHHIYVLNQVDHFRFNRAALINVGFLESSNSTDYIAMHDVDLLPLNEELDYGFPEAGPFHVA
SPELHPLYHYKTYVGGILLLSKQHYRLCNGMSNRFWGWGREDDEFYRRIKGAGLQLFRPSGI
TTGYKTFRHLHDPAWRKRDQKRIAAQKQEQFKVDREGGLNTVKYHVASRTALSVGGAPCTVL
NIMLDCDKTATPWCTFS
```

Signal peptide:
amino acids 1-42

Transmembrane domain:
amino acids 29-49 (type II)

N-glycosylation site.
amino acids 154-158 cAMP- and cGMP-dependent protein kinase phosphorylation site.
amino acids 27-31

Tyrosine kinase phosphorylation site.
amino acids 226-233

N-myristoylation site.
amino acids 19-25, 65-71, 247-253, 285-291, 303-309, 304-310

FIGURE 143

```
GTGGGATTTATTTGAGTGCAAGATCGTTTTCTCAGTGGTGGTGGAAGTTGCCTCATCGCAGGCAGATGTTGGGG
CTTTGTCCGAACAGCTCCCCTCTGCCAGCTTCTGTAGATAAGGGTTAAAAACTAATATTTATATGACAGAAGAA
AAAGATGTCATTCCGTAAAGTAAACATCATCATCTTGGTCCTGGCTGTTGCTCTCTTCTTACTGGTTTTGCACC
ATAACTTCCTCAGCTTGAGCAGTTTGTTAAGGAATGAGGTTACAGATTCAGGAATTGTAGGGCCTCAACCTATA
GACTTTGTCCCAAATGCTCTCCGACATGCAGTAGATGGGAGACAAGAGGAGATTCCTGTGGTCATCGCTGCATC
TGAAGACAGGCTTGGGGGGGCCATTGCAGCTATAAACAGCATTCAGCACAACACTCGCTCCAATGTGATTTTCT
ACATTGTTACTCTCAACAATACAGCAGACCATCTCCGGTCCTGGCTCAACAGTGATTCCCTGAAAAGCATCAGA
TACAAAATTGTCAATTTTGACCCTAAACTTTTGGAAGGAAAAGTAAAGGAGGATCCTGACCAGGGGGAATCCAT
GAAACCTTTAACCTTTGCAAGGTTCTACTTGCCAATTCTGGTTCCCAGCGCAAAGAAGGCCATATACATGGATG
ATGATGTAATTGTGCAAGGTGATATTCTTGCCCTTTACAATACAGCACTGAAGCCAGGACATGCAGCTGCATTT
TCAGAAGATTGTGATTCAGCCTCTACTAAAGTTGTCATCCGTGGAGCAGGAAACCAGTACAATTACATTGGCTA
TCTTGACTATAAAAAGGAAAGAATTCGTAAGCTTTCCATGAAAGCCAGCACTTGCTCATTTAATCCTGGAGTTT
TTGTTGCAAACCTGACGGAATGGAAACGACAGAATATAACTAACCAACTGGAAAAATGGATGAAACTCAATGTA
GAAGAGGGACTGTATAGCAGAACCCTGGCTGGTAGCATCACAACACCTCCTCTGCTTATCGTATTTATCAACA
GCACTCTACCATCGATCCTATGTGGAATGTCCGCCACCTTGGTTCCAGTGCTGGAAAACGATATTCACCTCAGT
TTGTAAAGGCTGCCAAGTTACTCCATTGGAATGGACATTTGAAGCCATGGGGAAGGACTGCTTCATATACTGAT
GTTTGGGAAAAATGGTATATTCCAGACCCAACAGGCAAATTCAACCTAATCCGAAGATATACCGAGATCTCAAA
CATAAAGTGAAACAGAATTTGAACTGTAAGCAACCATTTCTCAGGAAGTCCTGGAAGATAGCATGCATGGGAAG
TAACAGTTGCTAGGCTTCAATGCCTATCGGTAGCAAGCCATGGAAAAAGATGTGTCAGCTAGGTAAAGATGACA
AACTGCCCTGTCTGGCAGTCAGCTTCCCAGACAGACTATAGACTATAAATATGTCTCCATCTGCCTTACCAAGT
GTTTTCTTACTACAATGCTGAATGACTGGAAGAAGAACTGATATGGCTAGTTCAGCTAGCTGGTACAGATAAT
TCAAAACTGCTGTTGGTTTTAATTTTGTAACCTGTGGCCTGATCTGTAAATAAAACTTACATTTTTC
```

FIGURE 144

MSFRKVNIIILVLAVALFLLVLHHNFLSLSSLLRNEVTDSGIVGPQPIDFVPNALRHAVDGR
QEEIPVVIAASEDRLGGAIAAINSIQHNTRSNVIFYIVTLNNTADHLRSWLNSDSLKSIRYK
IVNFDPKLLEGKVKEDPDQGESMKPLTFARFYLPILVPSAKKAIYMDDDVIVQGDILALYNT
ALKPGHAAAFSEDCDSASTKVVIRGAGNQYNYIGYLDYKKERIRKLSMKASTCSFNPGVFVA
NLTEWKRQNITNQLEKWMKLNVEEGLYSRTLAGSITTPPLLIVFYQQHSTIDPMWNVRHLGS
SAGKRYSPQFVKAAKLLHWNGHLKPWGRTASYTDVWEKWYIPDPTGKFNLIRRYTEISNIK

FIGURE 145

AAACTTGACGCCATGAAGATCCCGGTCCTTCCTGCCGTGGTGCTCCTCTCCCTCCTGGTGCT
CCACTCTGCCCAGGGAGCCACCCTGGGTGGTCCTGAGGAAGAAAGCACCATTGAGAATTATG
CGTCACGACCCGAGGCCTTTAACACCCCGTTCCTGAACATCGACAAATTGCGATCTGCGTTT
AAGGCTGATGAGTTCCTGAACTGGCACGCCCTCTTTGAGTCTATCAAAAGGAAACTTCCTTT
CCTCAACTGGGATGCCTTTCCTAAGCTGAAAGGACTGAGGAGCGCAACTCCTGATGCCCAGT
GACCATGACCTCCACTGGAAGAGGGGGCTAGCGTGAGCGCTGATTCTCAACCTACCATAACT
CTTTCCTGCCTCAGGAACTCCAATAAACATTTTCCATCCAAA

FIGURE 146

MKIPVLPAVVLLSLLVLHSAQGATLGGPEEESTIENYASRPEAFNTPFLNIDKLRSAFKADE
FLNWHALFESIKRKLPFLNWDAFPKLKGLRSATPDAQ

FIGURE 147

CCTCTGTCCACTGCTTTCGTGAAGACAAGATGAAGTTCACAATTGTCTTTGCTGGACTTCTT
GGAGTCTTTCTAGCTCCTGCCCTAGCTAACTATAATATCAACGTCAATGATGACAACAACAA
TGCTGGAAGTGGGCAGCAGTCAGTGAGTGTCAACAATGAACACAATGTGGCCAATGTTGACA
ATAACAACGGATGGGACTCCTGGAATTCCATCTGGGATTATGGAAATGGCTTTGCTGCAACC
AGACTCTTTCAAAAGAAGACATGCATTGTGCACAAAATGAACAAGGAAGTCATGCCCTCCAT
TCAATCCCTTGATGCACTGGTCAAGGAAAAGAAGCTTCAGGGTAAGGGACCAGGAGGACCAC
CTCCCAAGGGCCTGATGTACTCAGTCAACCCAAACAAAGTCGATGACCTGAGCAAGTTCGGA
AAAAACATTGCAAACATGTGTCGTGGGATTCCAACATACATGGCTGAGGAGATGCAAGAGGC
AAGCCTGTTTTTTTACTCAGGAACGTGCTACACGACCAGTGTACTATGGATTGTGGACATTT
CCTTCTGTGGAGACACGGTGGAGAACTAAACAATTTTTTAAAGCCACTATGGATTTAGTCAT
CTGAATATGCTGTGCAGAAAAAATATGGGCTCCAGTGGTTTTTACCATGTCATTCTGAAATT
TTTCTCTACTAGTTATGTTTGATTTCTTTAAGTTTCAATAAAATCATTTAGCATTGAAAAAA

FIGURE 148

MKFTIVFAGLLGVFLAPALANYNINVNDDNNNAGSGQQSVSVNNEHNVANVDNNNGWDSWNS
IWDYGNGFAATRLFQKKTCIVHKMNKEVMPSIQSLDALVKEKKLQGKGPGGPPPKGLMYSVN
PNKVDDLSKFGKNIANMCRGIPTYMAEEMQEASLFFYSGTCYTTSVLWIVDISFCGDTVEN

Signal Peptide:
amino acids 1-20

N-myristoylation Sites:
amino acids 67-72, 118-123, 163-168

Flavodoxin protein homology:
amino acids 156-174

FIGURE 149

```
GGCACGAGCCAGGAACTAGGAGGTTCTCACTGCCCGAGCAGAGGCCCTACACCCACCGAGGC
ATGGGGCTCCCTGGGCTGTTCTGCTTGGCCGTGCTGGCTGCCAGCAGCTTCTCCAAGGCACG
GGAGGAAGAAATTACCCCTGTGGTCTCCATTGCCTACAAAGTCCTGGAAGTTTTCCCCAAAG
GCCGCTGGGTGCTCATAACCTGCTGTGCACCCCAGCCACCACCGCCCATCACCTATTCCCTC
TGTGGAACCAAGAACATCAAGGTGGCCAAGAAGGTGGTGAAGACCCACGAGCCGGCCTCCTT
CAACCTCAACGTCACACTCAAGTCCAGTCCAGACCTGCTCACCTACTTCTGCCGGGCGTCCT
CCACCTCAGGTGCCCATGTGGACAGTGCCAGGCTACAGATGCACTGGGAGCTGTGGTCCAAG
CCAGTGTCTGAGCTGCGGGCCAACTTCACTCTGCAGGACAGAGGGGCAGGCCCCAGGGTGGA
GATGATCTGCCAGGCGTCCTCGGGCAGCCCACCTATCACCAACAGCCTGATCGGGAAGGATG
GGCAGGTCCACCTGCAGCAGAGACCATGCCACAGGCAGCCTGCCAACTTCTCCTTCCTGCCG
AGCCAGACATCGGACTGGTTCTGGTGCCAGGCTGCAAACAACGCCAATGTCCAGCACAGCGC
CCTCACAGTGGTGCCCCCAGGTGGTGACCAGAAGATGGAGGACTGGCAGGGTCCCCTGGAGA
GCCCCATCCTTGCCTTGCCGCTCTACAGGAGCACCCGCCGTCTGAGTGAAGAGGAGTTTGGG
GGGTTCAGGATAGGGAATGGGGAGGTCAGAGGACGCAAAGCAGCAGCCATGTAGAATGAACC
GTCCAGAGAGCCAAGCACGGCAGAGGACTGCAGGCCATCAGCGTGCACTGTTCGTATTTGGA
GTTCATGCAAAATGAGTGTGTTTTAGCTGCTCTTGCCACAAAAAAAAAAAAAAAAAAAAAAA
```

FIGURE 150

MGLPGLFCLAVLAASSFSKAREEEITPVVSIAYKVLEVFPKGRWVLITCCAPQPPPPITYSL
CGTKNIKVAKKVVKTHEPASFNLNVTLKSSPDLLTYFCRASSTSGAHVDSARLQMHWELWSK
PVSELRANFTLQDRGAGPRVEMICQASSGSPPITNSLIGKDGQVHLQQRPCHRQPANFSFLP
SQTSDWFWCQAANNANVQHSALTVVPPGGDQKMEDWQGPLESPILALPLYRSTRRLSEEEFG
GFRIGNGEVRGRKAAAM

Signal Peptide:
amino acids 1-18

N-glycosylation Sites:
amino acids 86-89, 132-135, 181-184

FIGURE 151

GCGTGGGGATGTCTAGGAGCTCGAAGGTGGTGCTGGGCCTCTCGGTGCTGCTGACGGCGGCC
ACAGTGGCCGGCGTACATGTGAAGCAGCAGTGGGACCAGCAGAGGCTTCGTGACGGAGTTAT
CAGAGACATTGAGAGGCAAATTCGGAAAAAAGAAAACATTCGTCTTTTGGGAGAACAGATTA
TTTTGACTGAGCAACTTGAAGCAGAAAGAGAGAAGATGTTATTGGCAAAAGGATCTCAAAAA
TCATGACTTGAATGTGAAATATCTGTTGGACAGACAACACGAGTTTGTGTGTGTGTTGAT
GGAGAGTAGCTTAGTAGTATCTTCATCTTTTTTTTGGTCACTGTCCTTTTAAACTTGATCA
AATAAAGGACAGTGGGTCATATAAGTTACTGCTTTCAGGGTCCCTTATATCTGAATAAAGGA
GTGTGGGCAGACACTTTTTGGAAGAGTCTGTCTGGGTGATCCTGGTAGAAGCCCCATTAGGG
TCACTGTCCAGTGCTTAGGGTTGTTACTGAGAAGCACTGCCGAGCTTGTGAGAAGGAAGGGA
TGGATAGTAGCATCCACCTGAGTAGTCTGATCAGTCGGCATGATGACGAAGCCACGAGAACA
TCGACCTCAGAAGGACTGGAGGAAGGTGAAGTGGAGGGAGAGACGCTCCTGATCGTCGAATCC

FIGURE 152

MSRSSKVVLGLSVLLTAATVAGVHVKQQWDQQRLRDGVIRDIERQIRKKENIRLLGEQIILT
EQLEAEREKMLLAKGSQKS

FIGURE 153

```
AATGTGAGAGGGGCTGATGGAAGCTGATAGGCAGGACTGGAGTGTTAGCACCAGTACTGGAT
GTGACAGCAGGCAGAGGAGCACTTAGCAGCTTATTCAGTGTCCGATTCTGATTCCGGCAAGG
ATCCAAGCATGGAATGCTGCCGTCGGGCAACTCCTGGCACACTGCTCCTCTTTCTGGCTTTC
CTGCTCCTGAGTTCCAGGACCGCACGCTCCGAGGAGGACCGGGACGGCCTATGGGATGCCTG
GGGCCCATGGAGTGAATGCTCACGCACCTGCGGGGGAGGGGCCTCCTACTCTCTGAGGCGCT
GCCTGAGCAGCAAGAGCTGTGAAGGAAGAAATATCCGATACAGAACATGCAGTAATGTGGAC
TGCCCACCAGAAGCAGGTGATTTCCGAGCTCAGCAATGCTCAGCTCATAATGATGTCAAGCA
CCATGGCCAGTTTTATGAATGGCTTCCTGTGTCTAATGACCCTGACAACCCATGTTCACTCA
AGTGCCAAGCCAAAGGAACAACCCTGGTTGTTGAACTAGCACCTAAGGTCTTAGATGGTACG
CGTTGCTATACAGAATCTTTGGATATGTGCATCAGTGGTTTATGCCAAATTGTTGGCTGCGA
TCACCAGCTGGGAAGCACCGTCAAGGAAGATAACTGTGGGGTCTGCAACGGAGATGGGTCCA
CCTGCCGGCTGGTCCGAGGGCAGTATAAATCCCAGCTCTCCGCAACCAAATCGGATGATACT
GTGGTTGCACTTCCCTATGGAAGTAGACATATTCGCCTTGTCTTAAAAGGTCCTGATCACTT
ATATCTGGAAACCAAAACCCTCCAGGGGACTAAAGGTGAAAACAGTCTCAGCTCCACAGGAA
CTTTCCTTGTGGACAATTCTAGTGTGGACTTCCAGAAATTTCCAGACAAAGAGATACTGAGA
ATGGCTGGACCACTCACAGCAGATTTCATTGTCAAGATTCGTAACTCGGGCTCCGCTGACAG
TACAGTCCAGTTCATCTTCTATCAACCCATCATCCACCGATGGAGGGAGACGGATTTCTTTC
CTTGCTCAGCAACCTGTGGAGGAGGTTATCAGCTGACATCGGCTGAGTGCTACGATCTGAGG
AGCAACCGTGTGGTTGCTGACCAATACTGTCACTATTACCCAGAGAACATCAAACCCAAACC
CAAGCTTCAGGAGTGCAACTTGGATCCTTGTCCAGCCAGTGACGGATACAAGCAGATCATGC
CTTATGACCTCTACCATCCCCTTCCTCGGTGGGAGGCCACCCCATGGACCGCGTGCTCCTCC
TCGTGTGGGGGGGGCATCCAGAGCCGGGCAGTTTCCTGTGTGGAGGAGGACATCCAGGGGCA
TGTCACTTCAGTGGAAGAGTGGAAATGCATGTACACCCCTAAGATGCCCATCGCGCAGCCCT
GCAACATTTTTGACTGCCCTAAATGGCTGGCACAGGAGTGGTCTCCGTGCACAGTGACATGT
GGCCAGGGCCTCAGATACCGTGTGGTCCTCTGCATCGACCATCGAGGAATGCACACAGGAGG
CTGTAGCCCAAAAACAAAGCCCCACATAAAAGAGGAATGCATCGTACCCACTCCCTGCTATA
AACCCAAAGAGAAACTTCCAGTCGAGGCCAAGTTGCCATGGTTCAAACAAGCTCAAGAGCTA
GAAGAAGGAGCTGCTGTGTCAGAGGAGCCCTCGTAAGTTGTAAAAGCACAGACTGTTCTATA
TTTGAAACTGTTTTGTTTAAAGAAAGCAGTGTCTCACTGGTTGTAGCTTTCATGGGTTCTGA
ACTAAGTGTAATCATCTCACCAAAGCTTTTGGCTCTCAAATTAAAGATTGATTAGTTTCAA
AAAAAAAA
```

FIGURE 154

```
</usr/seqdb2/sst/DNA/Dnaseqs.min/ss.DNA58847
<subunit 1 of 1, 525 aa, 1 stop
<MW: 58416, pI: 6.62, NX(S/T): 1
MECCRRATPGTLLLFLAFLLLSSRTARSEEDRDGLWDAWGPWSECSRTCGGGASYSLRRCLS
SKSCEGRNIRYRTCSNVDCPPEAGDFRAQQCSAHNDVKHHGQFYEWLPVSNDPDNPCSLKCQ
AKGTTLVVELAPKVLDGTRCYTESLDMCISGLCQIVGCDHQLGSTVKEDNCGVCNGDGSTCR
LVRGQYKSQLSATKSDDTVVALPYGSRHIRLVLKGPDHLYLETKTLQGTKGENSLSSTGTFL
VDNSSVDFQKFPDKEILRMAGPLTADFIVKIRNSGSADSTVQFIFYQPIIHRWRETDFFPCS
ATCGGGYQLTSAECYDLRSNRVVADQYCHYYPENIKPKPKLQECNLDPCPASDGYKQIMPYD
LYHPLPRWEATPWTACSSSCGGGIQSRAVSCVEEDIQGHVTSVEEWKCMYTPKMPIAQPCNI
FDCPKWLAQEWSPCTVTCGQGLRYRVVLCIDHRGMHTGGCSPKTKPHIKEECIVPTPCYKPK
EKLPVEAKLPWFKQAQELEEGAAVSEEPS
```

Important features:
Signal peptide:
amino acids 1-25

N-glycosylation site.
amino acids 251-254

Thrombospondin 1
amino acids 385-399 von Willebrand factor type C domain proteins
amino acids 385-399, 445-459 and 42-56

FIGURE 155

```
GTGGACTCTGAGAAGCCCAGGCAGTTGAGGACAGGAGAGAGAAGGCTGCAGACCCAGAGGGAGGGAGGACAGGG
AGTCGGAAGGAGGAGGACAGAGGAGGGCACAGAGACGCAGAGCAAGGGCGGCAAGGAGGAGACCCTGGTGGGAG
GAAGACACTCTGGAGAGAGAGGGGGCTGGGCAGAGATGAAGTTCCAGGGGCCCCTGGCCTGCCTCCTGCTGGCC
CTCTGCCTGGGCAGTGGGGAGGCTGGCCCCCTGCAGAGCGGAGAGGAAAGCACTGGGACAAATATTGGGGAGGC
CCTTGGACATGGCCTGGGAGACGCCCTGAGCGAAGGGGTGGGAAAGGCCATTGGCAAAGAGGCCGGAGGGGCAG
CTGGCTCTAAAGTCAGTGAGGCCCTTGGCCAAGGGACCAGAGAAGCAGTTGGCACTGGAGTCAGGCAGGTTCCA
GGCTTTGGCGCAGCAGATGCTTTGGGCAACAGGGTCGGGGAAGCAGCCCATGCTCTGGGAAACACTGGGCACGA
GATTGGCAGACAGGCAGAAGATGTCATTCGACACGGAGCAGATGCTGTCCGCGGCTCCTGGCAGGGGGTGCCTG
GCCACAGTGGTGCTTGGGAAACTTCTGGAGGCCATGGCATCTTTGGCTCTCAAGGTGGCCTTGGAGGCCAGGGC
CAGGGCAATCCTGGAGGTCTGGGGACTCCGTGGGTCCACGGATACCCCGGAAACTCAGCAGGCAGCTTTGGAAT
GAATCCTCAGGGAGCTCCCTGGGGTCAAGGAGGCAATGGAGGGCCACCAAACTTTGGGACCAACACTCAGGGAG
CTGTGGCCCAGCCTGGCTATGGTTCAGTGAGAGCCAGCAACCAGAATGAAGGGTGCACGAATCCCCCACCATCT
GGCTCAGGTGGAGGCTCCAGCAACTCTGGGGGAGGCAGCGGCTCACAGTCGGGCAGCAGTGGCAGTGGCAGCAA
TGGTGACAACAACAATGGCAGCAGCAGTGGTGGCAGCAGCAGTGGCAGCAGCAGTGGCAGCAGCAGTGGCGGCA
GCAGTGGCGGCAGCAGTGGTGGCAGCAGTGGCAACAGTGGTGGCAGCAGAGGTGACAGCGGCAGTGAGTCCTCC
TGGGGATCCAGCACCGGCTCCTCCTCCGGCAACCACGGTGGGAGCGGCGGAGGAAATGGACATAAACCCGGGTG
TGAAAAGCCAGGGAATGAAGCCCGCGGGAGCGGGGAATCTGGGATTCAGGGCTTCAGAGGACAGGGAGTTTCCA
GCAACATGAGGGAAATAAGCAAAGAGGGCAATCGCCTCCTTGGAGGCTCTGGAGACAATTATCGGGGCAAGGG
TCGAGCTGGGGCAGTGGAGGAGGTGACGCTGTTGGTGGAGTCAATACTGTGAACTCTGAGACGTCTCCTGGGAT
GTTTAACTTTGACACTTTCTGGAAGAATTTTAAATCCAAGCTGGGTTTCATCAACTGGGATGCCATAAACAAGG
ACCAGAGAAGCTCTCGCATCCCGTGACCTCCAGACAAGGAGCCACCAGATTGGATGGGAGCCCCCACACTCCCT
CCTTAAAACACCACCCTCTCATCACTAATCTCAGCCCTTGCCCTTGAAATAAACCTTAGCTGCCCCACAAAAAA
AAAAAAAAAAAAAAAAAAAAAAAAAAAAAAAAAAAAAAAAAAAAAAAAAAAAAAAAAAAAAAAAAAAAAAAAAA
AAAAAAAAAAAAAAAAAAAAAAAAAAAAAA
```

FIGURE 156

></usr/seqdb2/sst/DNA/Dnaseqs.min/ss.DNA59212
><subunit 1 of 1, 440 aa, 1 stop
><MW: 42208, pI: 6.36, NX(S/T): 1
MKFQGPLACLLLALCLGSGEAGPLQSGEESTGTNIGEALGHGLGDALSEGVGKAIGKEAGGA
AGSKVSEALGQGTREAVGTGVRQVPGFGAADALGNRVGEAAHALGNTGHEIGRQAEDVIRHG
ADAVRGSWQGVPGHSGAWETSGGHGIFGSQGGLGGQGQGNPGGLGTPWVHGYPGNSAGSFGM
NPQGAPWGQGGNGGPPNFGTNTQGAVAQPGYGSVRASNQNEGCTNPPPSGSGGGSSNSGGGS
GSQSGSSGSGSNGDNNNGSSSGGSSSGSSSGSSSGGSSGGSSGGSSGNSGGSRGDSGSESSW
GSSTGSSSGNHGGSGGGNGHKPGCEKPGNEARGSGESGIQGFRGQGVSSNMREISKEGNRLL
GGSGDNYRGQGSSWGSGGGDAVGGVNTVNSETSPGMFNFDTFWKNFKSKLGFINWDAINKDQ
RSSRIP

Signal peptide:
amino acids 1-21

N-glycosylation site.
amino acids 265-269

Glycosaminoglycan attachment site.
amino acids 235-239, 237-241, 244-248, 255-259, 324-328, 388-392

Casein kinase II phosphorylation site.
amino acids 26-30, 109-113, 259-263, 300-304, 304-308

N-myristoylation site.
amino acids 17-23, 32-38, 42-48, 50-56, 60-66, 61-67, 64-70, 74-80, 90-96, 96-102, 130-136, 140-146, 149-155, 152-158, 155-161, 159-165, 163-169, 178-184, 190-196, 194-200, 199-205, 218-224, 236-242, 238-244, 239-245, 240-246, 245-251, 246-252, 249-252, 253-259, 256-262, 266-272, 270-276, 271-277, 275-281, 279-285, 283-289, 284-290, 287-293, 288-294, 291-297, 292-298, 295-301, 298-304, 305-311, 311-317, 315-321, 319-325, 322-328, 323-329, 325-331, 343-349, 354-360, 356-362, 374-380, 381-387, 383-389, 387-393, 389-395, 395-401

Cell attachment sequence.
amino acids 301-304

FIGURE 157

```
CCCACGCGTCCGCCCACGCGTCCGCCCACGCGTCCGCCCACGCGTCCGCCCACGCGTCCGCCCACGCGTCCGCC
CACGCGTCCGGTGCAAGCTCGCGCCGCACACTGCCTGGTGGAGGGAAGGAGCCCGGGCGCCTCTCGCCGCTCCC
CGCGCCGCCGTCCGCACCTCCCCACCGCCCGCCGCCCGCCGCCCGCCCGCAAAGCATGAGTGAGCCCGCTC
TCTGCAGCTGCCCGGGGCGCGAATGGCAGGCTGTTTCCGCGGAGTAAAAGGTGGCGCCGGTCAGTGGTCGTTTC
CAATGACGGACATTAACCAGACTGTCAGATCCTGGGGAGTCGCGAGCCCCGAGTTTGGAGTTTTTTCCCCCCAC
AACGTCACAGTCCGAACTGCAGAGGGAAAGGAAGGCGGCAGGAAGGCGAAGCTCGGGCTCCGGCACGTAGTTGG
GAAACTTGCGGGTCCTAGAAGTCGCCTCCCCGCCTTGCCGGCCGCCCTTGCAGCCCCGAGCCGAGCAGCAAAGT
GAGACATTGTGCGCCTGCCAGATCCGCCGGCCGCGGACCGGGGCTGCCTCGGAAACACAGAGGGGTCTTCTCTC
GCCCTGCATATAATTAGCCTGCACACAAAGGGAGCAGCTGAATGGAGGTTGTCACTCTCTGGAAAAGGATTTCT
GACCGAGCGCTTCCAATGGACATTCTCCAGTCTCTCTGGAAAGATTCTCGCTAATGGATTTCCTGCTGCTCGGT
CTCTGTCTATACTGGCTGCTGAGGAGGCCCTCGGGGGTGGTCTTGTGTCTGCTGGGGGCCTGCTTTCAGATGCT
GCCCGCCGCCCCCAGCGGGTGCCCGCAGCTGTGCCGGTGCGAGGGGCCGCTGCTGTACTGCGAGGCGCTCAACC
TCACCGAGGCGCCCCACAACCTGTCCGGCCTGCTGGGCTTGTCCCTGCGCTACAACAGCCTCTCGGAGCTGCGC
GCCGGCCAGTTCACGGGGTTAATGCAGCTCACGTGGCTCTATCTGGATCACAATCACATCTGCTCCGTGCAGGG
GGACGCCTTTCAGAAACTGCGCCGAGTTAAGGAACTCACGCTGAGTTCCAACCAGATCACCCAACTGCCCAACA
CCACCTTCCGGCCCATGCCCAACCTGCGCAGCGTGGACCTCTCGTACAACAAGCTGCAGGCGCTCGCGCCCGAC
CTCTTCCACGGGCTGCGGAAGCTCACCACGCTGCATATGCGGGCCAACGCCATCCAGTTTGTGCCCGTGCGCAT
CTTCCAGGACTGCCGCAGCCTCAAGTTTCTCGACATCGGATACAATCAGCTCAAGAGTCTGGCGCGCAACTCTT
TCGCCGGCTTGTTTAAGCTCACCGAGCTGCACCTCGAGCACAACGACTTGGTCAAGGTGAACTTCGCCCACTTC
CCGCGCCTCATCTCCCTGCACTCGCTCTGCCTGCGGAGGAACAAGGTGGCCATTGTGGTCAGCTCGCTGGACTG
GGTTTGGAACCTGGAGAAAATGGACTTGTCGGGCAACGAGATCGAGTACATGGAGCCCCATGTGTTCGAGACCG
TGCCGCACCTGCAGTCCCTGCAGCTGGACTCCAACCGCCTCACCTACATCGAGCCCCGGATCCTCAACTCTTGG
AAGTCCCTGACAAGCATCACCCTGGCCGGGAACCTGTGGGATTGCGGGCGCAACGTGTGTGCCCTAGCCTCGTG
GCTCAGCAACTTCCAGGGGCGCTACGATGGCAACTTGCAGTGCGCCAGCCCGGAGTACGCACAGGGCGAGGACG
TCCTGGACGCCGTGTACGCCTTCCACCTGTGCGAGGATGGGGCCGAGCCCACCAGCGGCCACCTGCTCTCGGCC
GTCACCAACCGCAGTGATCTGGGGCCCCCTGCCAGCTCGGCCACCACGCTCGCGGACGGCGGGGAGGGGCAGCA
CGACGGCACATTCGAGCCTGCCACCGTGGCTCTTCCAGGCGGCGAGCACGCCGAGAACGCCGTGCAGATCCACA
AGGTGGTCACGGGCACCATGGCCCTCATCTTCTCCTTCCTCATCGTGGTCCTGGTGCTCTACGTGTCCTGGAAG
TGTTTCCCAGCCAGCCTCAGGCAGCTCAGACAGTGCTTTGTCACGCAGCGCAGGAAGCAAAGCAGAAACAGAC
CATGCATCAGATGGCTGCCATGTCTGCCCAGGAATACTACGTTGATTACAAACCGAACCACATTGAGGGAGCCC
TGGTGATCATCAACGAGTATGGCTCGTGTACCTGCCACCAGCAGCCCGCGAGGGAATGCGAGGTGTGATTGTCC
CAGTGGCTCTCAACCCATGCGCTACCAAATACGCCTGGGCAGCCGGGACGGGCCGGCGGGCACCAGGCTGGGGT
CTCCTTGTCTGTGCTCTGATATGCTCCTTGACTGAAACTTTAAGGGGATCTCTCCCAGAGACTTGACATTTTAG
CTTTATTGTGTCTTAAAAACAAAAGCGAATTAAAACACAACAAAAAACCCCACCCCACAACCTTCAGGACAGTC
TATCTTAAATTTCATATGAGAACTCCTTCCTCCCTTTGAAGATCTGTCCATATTCAGGAATCTGAGAGTGTAAA
AAAGGTGGCCATAAGACAGAGAGAGAATAATCGTGCTTTGTTTATGCTACTCCTCCCACCCTGCCCATGATTA
AACATCATGTATGTAGAAGATCTTAAGTCCATACGCATTTCATGAAGAACCATTGGAAAGAGGAATCTGCAATC
TGGCAGCTTAAGAGCAAATGATGACCATAGAAAGCTATGTTCTTACTTTGTGTGTGTGTCTGTATGTTTCTGCG
TTGTGTGTCTTTGTAGGCAAGCAAACGTTGTCTACACAAACGGGAATTTAGCTCACATCATTTCATGCCCCTGT
GCCTCTAGCTCTGGAGATTGGTGGGGGGAGGTGGGGGGAAACGGCAGGAATAAGGGAAAGTGGTAGTTTTAACT
AAGGTTTTGTAACACTTGAAATCTTTTCTTTCTCAAATTAATTATCTTTAAGCTTCAAGAAACTTGCTCTGACC
CCTCTAAGCAAACTACTAAGCATTTAAAAGAGAATCTAATTTTTAAAGGTGTAGCACCTTTTTTTTTATTCTTC
CCACAGAGGGTGCTAATCTCATTATGCTGTGCTATCTGAAAAGAACTTAAGGCCACAATTCACGTCTCGTCCTG
GGCATTGTGATGGATTGACCCTCCATTTGCAGTACCTTCCCAGCTGATTAAAGTTCAGCAGTGGTATTGAGGTT
TTTCGAATATTTATATAGAAAAAAAGTCTTTTCACATGACAAATGACACTCTCACACCAGTCTTAGCCCTAGTA
GTTTTTTAGGTTGGACCAGAGGAAGCAGGTTAAATGAGACCTGTCCTCTGCTGCACTCAGAAAAAATAGGCAGT
CCCTGATGCTCAGATCTTAGCCTTGATATTAATAGTTGAGACCACCTACCCCACAATGCAGCCTATACTCCCAAG
ACTACAAAGTTACCATCGCAAAGGAAAGGTTATTCCAGTAAAAGGAAATAGTTTTCTCAACCATTTAAAAATAT
TCTTCTGAACTCATCAAAGTAGAAGAGCCCCCAACCTTTTCTCTCTGCCTTCAAGAAGGCAGACATTTGGTATG
ATTTAGCATCAACAACACATTTATGAGTATATGTAAGTAATCAGAGGGGCAAATGCCACTTGTTATTCCTCCCA
AGTTTTCCAAGCAAGTACACACAGATCTCTGGTAGGATTAGGGGCCACTTGTGTTTCCGGCTTATTTTAGTCGA
CTTGTCAGCAAGTTTGATGCCTAGTCTATCTGACATGGCCCAGTAGAACAGGGCATTGATGGATCACATGAGAT
GGTAGAAGGAACATCATCACATACCCCTCTCACAGAGAAAATTATCAAAGAACCAGAAATTATATCTGTTTTGG
AGCAAGAGTGTCATAATGTTTCAGGGTAGTCAAAATAAACATAAATTATCTCCTCTAGATGAGTGGCGATGTTG
GCTGATTTGGGTCTGCCATTGACAGAATGTCAAATAAAAAGGAATTAGCTAGAATATGACCATTAAATGCTT
CTGAAATATATTTTGAGATAGGTTTAGAATGTCA
```

FIGURE 158

MDFLLLGLCLYWLLRRPSGVVLCLLGACFQMLPAAPSGCPQLCRCEGRLLYCEALNLTEAPHNLSGLLGLSLRY
NSLSELRAGQFTGLMQLTWLYLDHNHICSVQGDAFQKLRRVKELTLSSNQITQLPNTTFRPMPNLRSVDLSYNK
LQALAPDLFHGLRKLTTLHMRANAIQFVPVRIFQDCRSLKFLDIGYNQLKSLARNSFAGLFKLTELHLEHNDLV
KVNFAHFPRLISLHSLCLRRNKVAIVVSSLDWVWNLEKMDLSGNEIEYMEPHVFETVPHLQSLQLDSNRLTYIE
PRILNSWKSLTSITLAGNLWDCGRNVCALASWLSNFQGRYDGNLQCASPEYAQGEDVLDAVYAFHLCEDGAEPT
SGHLLSAVTNRSDLGPPASSATTLADGGEGQHDGTFEPATVALPGGEHAENAVQIHKVVTGTMALIFSFLIVVL
VLYVSWKCFPASLRQLRQCFVTQRRKQKQKQTMHQMAAMSAQEYYVDYKPNHIEGALVIINEYGSCTCHQQPAR
ECEV

FIGURE 159

```
CAGAGAGGAGGCTTTGGGAATTGTCCAGCAGAAACAGAGAAGTCTGAGGTGGTGTCAAGACA
AAAGATGCTTCAGCTTTGGAAACTTGTTCTCCTGTGCGGCGTGCTCACTGGGACCTCAGAGTCT
CTTCTTGACAATCTTGGCAATGACCTAAGCAATGTCGTGGATAAGCTGGAACCTGTTCTTCA
CGAGGGACTTGAGACAGTTGACAATACTCTTAAAGGCATCCTTGAGAAACTGAAGGTCGACC
TAGGAGTGCTTCAGAAATCCAGTGCTTGGCAACTGGCCAAGCAGAAGGCCCAGGAAGCTGAG
AAATTGCTGAACAATGTCATTTCTAAGCTGCTTCCAACTAACACGGACATTTTTGGGTTGAA
AATCAGCAACTCCCTCATCCTGGATGTCAAAGCTGAACCGATCGATGATGGCAAAGGCCTTA
ACCTGAGCTTCCCTGTCACCGCGAATGTCACTGTGGCCGGGCCCATCATTGGCCAGATTATC
AACCTGAAAGCCTCCTTGGACCTCCTGACCGCAGTCACAATTGAAACTGATCCCCAGACACA
CCAGCCTGTTGCCGTCCTGGGAGAATGCGCCAGTGACCCAACCAGCATCTCACTTTCCTTGC
TGGACAAACACAGCCAAATCATCAACAAGTTCGTGAATAGCGTGATCAACACGCTGAAAAGC
ACTGTATCCTCCCTGCTGCAGAAGGAGATATGTCCACTGATCCGCATCTTCATCCACTCCCT
GGATGTGAATGTCATTCAGCAGGTCGTCGATAATCCTCAGCACAAAACCCAGCTGCAAACCC
TCATCTGAAGAGGACGAATGAGGAGGACCACTGTGGTGCATGCTGATTGGTTCCCAGTGGCT
TGCCCCACCCCCTTATAGCATCTCCCTCCAGGAAGCTGCTGCCACCACCTAACCAGCGTGAA
AGCCTGAGTCCCACCAGAAGGACCTTCCCAGATACCCCTTCTCCTCACAGTCAGAACAGCAG
CCTCTACACATGTTGTCCTGCCCCTGGCAATAAAGGCCCATTTCTGCACCCTTAA
```

FIGURE 160

```
></usr/seqdb2/sst/DNA/Dnaseqs.min/ss.DNA59622
><subunit 1 of 1, 249 aa, 1 stop
><MW: 27011, pI: 5.48, NX(S/T): 2
MLQLWKLVLLCGVLTGTSESLLDNLGNDLSNVVDKLEPVLHEGLETVDNTLKGILEKLKV
DLGVLQKSSAWQLAKQKAQEAEKLLNNVISKLLPTNTDIFGLKISNSLILDVKAEPIDDG
KGLNLSFPVTANVTVAGPIIGQIINLKASLDLLTAVTIETDPQTHQPVAVLGECASDPTS
ISLSLLDKHSQIINKFVNSVINTLKSTVSSLLQKEICPLIRIFIHSLDVNVIQQVVDNPQ
HKTQLQTLI
```

Important features:
Signal peptide:
Amino acids      1-15

N-glycosylation sites:
Amino acids      124-128;132-136

N-myristoylation sites:
Amino acids      12-18;16-22;26-32;101-107;122-128;141-147

Leucine zipper pattern:
Amino acids      44-66

FIGURE 161

```
CAGCCACAGACGGGTCATGAGCGCGGTATTACTGCTGGCCCTCCTGGGGTTCATCCTCCCAC
TGCCAGGAGTGCAGGCGCTGCTCTGCCAGTTTGGGACAGTTCAGCATGTGTGGAAGGTGTCC
GACCTACCCCGGCAATGGACCCCTAAGAACACCAGCTGCGACAGCGGCTTGGGGTGCCAGGA
CACGTTGATGCTCATTGAGAGCGGACCCCAAGTGAGCCTGGTGCTCTCCAAGGGCTGCACGG
AGGCCAAGGACCAGGAGCCCCGCGTCACTGAGCACCGGATGGGCCCCGGCCTCTCCCTGATC
TCCTACACCTTCGTGTGCCGCCAGGAGGACTTCTGCAACAACCTCGTTAACTCCCTCCCGCT
TTGGGCCCCACAGCCCCCAGCAGACCCAGGATCCTTGAGGTGCCCAGTCTGCTTGTCTATGG
AAGGCTGTCTGGAGGGGACAACAGAAGAGATCTGCCCCAAGGGGACCACACACTGTTATGAT
GGCCTCCTCAGGCTCAGGGGAGGAGGCATCTTCTCCAATCTGAGAGTCCAGGGATGCATGCC
CCAGCCAGGTTGCAACCTGCTCAATGGACACAGGAAATTGGGCCCGTGGGTATGACTGAGA
ACTGCAATAGGAAAGATTTTCTGACCTGTCATCGGGGACCACCATTATGACACACGGAAAC
TTGGCTCAAGAACCCACTGATTGGACCACATCGAATACCGAGATGTGCGAGGTGGGGCAGGT
GTGTCAGGAGACGCTGCTGCTCATAGATGTAGGACTCACATCAACCCTGGTGGGGACAAAAG
GCTGCAGCACTGTTGGGGCTCAAAATTCCCAGAAGACCACCATCCACTCAGCCCCTCCTGGG
GTGCTTGTGGCCTCCTATACCCACTTCTGCTCCTCGGACCTGTGCAATAGTGCCAGCAGCAG
CAGCGTTCTGCTGAACTCCCTCCCTCCTCAAGCTGCCCCTGTCCCAGGAGACCGGCAGTGTC
CTACCTGTGTGCAGCCCCTTGGAACCTGTTCAAGTGGCTCCCCCCGAATGACCTGCCCCAGG
GGCGCCACTCATTGTTATGATGGGTACATTCATCTCTCAGGAGGTGGGCTGTCCACCAAAAT
GAGCATTCAGGGCTGCGTGGCCCAACCTTCCAGCTTCTTGTTGAACCACACCAGACAAATCG
GGATCTTCTCTGCGCGTGAGAAGCGTGATGTGCAGCCTCCTGCCTCTCAGCATGAGGGAGGT
GGGGCTGAGGGCCTGGAGTCTCTCACTTGGGGGGTGGGGCTGGCACTGGCCCCAGCGCTGTG
GTGGGGAGTGGTTTGCCCTTCCTGCTAACTCTATTACCCCACGATTCTTCACCGCTGCTGA
CCACCCACACTCAACCTCCCTCTGACCTCATAACCTAATGGCCTTGGACACCAGATTCTTTC
CCATTCTGTCCATGAATCATCTTCCCCACACACAATCATTCATATCTACTCACCTAACAGCA
ACACTGGGGAGAGCCTGGAGCATCCGGACTTGCCCTATGGGAGAGGGACGCTGGAGGAGTG
GCTGCATGTATCTGATAATACAGACCCTGTCCTTTCA
```

FIGURE 162

```
></usr/seqdb2/sst/DNA/Dnaseqs.min/ss.DNA59847
><subunit 1 of 1, 437 aa, 1 stop
><MW: 46363, pI: 6.22, NX(S/T): 3
MSAVLLLALLGFILPLPGVQALLCQFGTVQHVWKVSDLPRQWTPKNTSCDSGLGCQDTLM
LIESGPQVSLVLSKGCTEAKDQEPRVTEHRMGPGLSLISYTFVCRQEDFCNNLVNSLPLW
APQPPADPGSLRCPVCLSMEGCLEGTTEEICPKGTTHCYDGLLRLRGGGIFSNLRVQGCM
PQPGCNLLNGTQEIGPVGMTENCNRKDFLTCHRGTTIMTHGNLAQEPTDWTTSNTEMCEV
GQVCQETLLLIDVGLTSTLVGTKGCSTVGAQNSQKTTIHSAPPGVLVASYTHFCSSDLCN
SASSSSVLLNSLPPQAAPVPGDRQCPTCVQPLGTCSSGSPRMTCPRGATHCYDGYIHLSG
GGLSTKMSIQGCVAQPSSFLLNHTRQIGIFSAREKRDVQPPASQHEGGGAEGLESLTWGV
GLALAPALWWGVVCPSC Important features of the protein:
Signal peptide:
Amino acids    1-15

Transmembrane domain:
Amino acids    243-260

N-glycosylation sites:
Amino acids    46-50;189-193;382-386

Glycosaminoglycan attachment sites:
Amino acids    51-55;359-363

N-myristoylation sites:
Amino acids    54-60;75-81;141-147;154-160;168-174;169-175;
               198-204;254-260;261-267;269-275;284-290;333-339
               347-353;360-366;361-367;388-394;408-414;419-425
```

FIGURE 163

```
GAGGATTTGCCACAGCAGCGGATAGAGCAGGAGAGCACCACCGGAGCCCTTGAGACATCCTTGAGAAGAGCCAC
AGCATAAGAGACTGCCCTGCTTGGTGTTTTGCAGGATGATGGTGGCCCTTCGAGGAGCTTCTGCATTGCTGGTT
CTGTTCCTTGCAGCTTTTCTGCCCCCGCCGCAGTGTACCCAGGACCCAGCCATGGTGCATTACATCTACCAGCG
CTTTCGAGTCTTGGAGCAAGGGCTGGAAAAATGTACCCAAGCAACGAGGGCATACATTCAAGAATTCCAAGAGT
TCTCAAAAAATATATCTGTCATGCTGGGAAGATGTCAGACCTACACAAGTGAGTACAAGAGTGCAGTGGGTAAC
TTGGCACTGAGAGTTGAACGTGCCCAACGGGAGATTGACTACATACAATACCTTCGAGAGGCTGACGAGTGCAT
CGTATCAGAGGACAAGACACTGGCAGAAATGTTGCTCCAAGAAGCTGAAGAAGAGAAAAAGATCCGGACTCTGC
TGAATGCAAGCTGTGACAACATGCTGATGGGCATAAAGTCTTTGAAAATAGTGAAGAAGATGATGGACACACAT
GGCTCTTGGATGAAAGATGCTGTCTATAACTCTCCAAAGGTGTACTTATTAATTGGATCCAGAAACAACACTGT
TTGGGAATTTGCAAACATACGGGCATTCATGGAGGATAACACCAAGCCAGCTCCCCGGAAGCAAATCCTAACAC
TTTCCTGGCAGGGAACAGGCCAAGTGATCTACAAAGGTTTTCTATTTTTTCATAACCAAGCAACTTCTAATGAG
ATAATCAAATATAACCTGCAGAAGAGGACTGTGGAAGATCGAATGCTGCTCCCAGGAGGGGTAGGCCGAGCATT
GGTTTACCAGCACTCCCCCTCAACTTACATTGACCTGGCTGTGGATGAGCATGGGCTCTGGGCCATCCACTCTG
GGCCAGGCACCCATAGCCATTTGGTTCTCACAAAGATTGAGCCGGGCACACTGGGAGTGGAGCATTCATGGGAT
ACCCCATGCAGAAGCCAGGATGCTGAAGCCTCATTCCTCTTGTGTGGGGTTCTCTATGTGGTCTACAGTACTGG
GGGCCAGGGCCCTCATCGCATCACCTGCATCTATGATCCACTGGGCACTATCAGTGAGGAGGACTTGCCCAACT
TGTTCTTCCCCAAGAGACCAAGAAGTCACTCCATGATCCATTACAACCCCAGAGATAAGCAGCTCTATGCCTGG
AATGAAGGAAACCAGATCATTTACAAACTCCAGACAAAGAGAAAGCTGCCTCTGAAGTAATGCATTACAGCTGT
GAGAAAGAGCACTGTGGCTTTGGCAGCTGTTCTACAGGACAGTGAGGCTATAGCCCCTTCACAATATAGTATCC
CTCTAATCACACACAGGAAGAGTGTGTAGAAGTGGAAATACGTATGCCTCCTTTCCCAAATGTCACTGCCTTAG
GTATCTTCCAAGAGCTTAGATGAGAGCATATCATCAGGAAAGTTTCAACAATGTCCATTACTCCCCAAACCTC
CTGGCTCTCAAGGATGACCACATTCTGATACAGCCTACTTCAAGCCTTTTGTTTTACTGCTCCCCAGCATTTAC
TGTAACTCTGCCATCTTCCCTCCCACAATTAGAGTTGTATGCCAGCCCCTAATATTCACCACTGGCTTTTCTCT
CCCCTGGCCTTTGCTGAAGCTCTTCCCTCTTTTTCAAATGTCTATTGATATTCTCCCATTTTCACTGCCCAACT
AAAATACTATTAATATTTCTTTCTTTTCTTTTCTTTTTTTGAGACAAGGTCTCACTATGTTGCCCAGGCTGGT
CTCAAACTCCAGAGCTCAAGAGATCCTCCTGCCTCAGCCTCTAAGTACCTGGGATTACAGGCATGTGCCACCA
CACCTGGCTTAAAATACTATTTCTTATTGAGGTTTAACCTCTATTTCCCCTAGCCCTGTCCTTCCACTAAGCTT
GGTAGATGTAATAATAAAGTGAAAATATTAACATTTGAATATCGCTTTCCAGGTGTGGAGTGTTTGCACATCAT
TGAATTCTCGTTTCACCTTTGTGAAACATGCACAAGTCTTTACAGCTGTCATTCTAGAGTTTAGGTGAGTAACA
CAATTACAAAGTGAAAGATACAGCTACAAAATACTACAAATCCCATAGTTTTTCCATTGCCCAAGGAAGCATCA
AATACGTATGTTTGTTCACCTACTCTTATAGTCAATGCGTTCATCGTTTCAGCCTAAAAATAATAGTCTGTCCC
TTTAGCCAGTTTTCATGTCTGCACAAGACCTTTCAATAGGCCTTTCAAATGATAATTCCTCAGAAACCAGTC
TAAGGGTGAGGACCCCAACTCTAGCCTCCTCTTGTCTTGCTGTCCTCTGTTTCTCTCTTTCTGCTTTAAATTCA
ATAAAAGTGACACTGAGCAAAAAAAAAAAAAAA
```

FIGURE 164

MMVALRGASALLVLFLAAFLPPPQCTQDPAMVHYIYQRFRVLEQGLEKCTQATRAYIQEFQEFSKNISVMLGRC
QTYTSEYKSAVGNLALRVERAQREIDYIQYLREADECIVSEDKTLAEMLLQEAEEEKKIRTLLNASCDNMLMGI
KSLKIVKKMMDTHGSWMKDAVYNSPKVYLLIGSRNNTVWEFANIRAFMEDNTKPAPRKQILTLSWQGTGQVIYK
GFLFFHNQATSNEIIKYNLQKRTVEDRMLLPGGVGRALVYQHSPSTYIDLAVDEHGLWAIHSGPGTHSHLVLTK
IEPGTLGVEHSWDTPCRSQDAEASFLLCGVLYVVYSTGGQGPHRITCIYDPLGTISEEDLPNLFFPKRPRSHSM
IHYNPRDKQLYAWNEGNQIIYKLQTKRKLPLK

FIGURE 165

TGGCCTCCCCAGCTTGCCAGGCACAAGGCTGAGCGGGAGGAAGCGAGAGGCATCTAAGCAGGCAGTGTTTTGCC
TTCACCCCAAGTGACCATGAGAGGTGCCACGCGAGTCTCAATCATGCTCCTCCTAGTAACTGTGTCTGACTGTG
CTGTGATCACAGGGGCCTGTGAGCGGGATGTCCAGTGTGGGGCAGGCACCTGCTGTGCCATCAGCCTGTGGCTT
CGAGGGCTGCGGATGTGCACCCCGCTGGGGCGGGAAGGCGAGGAGTGCCACCCCGGCAGCCACAAGGTCCCCTT
CTTCAGGAAACGCAAGCACCACACCTGTCCTTGCTTGCCCAACCTGCTGTGCTCCAGGTTCCCGGACGGCAGGT
ACCGCTGCTCCATGGACTTGAAGAACATCAATTTTTAGGCGCTTGCCTGGTCTCAGGATACCCACCATCCTTTT
CCTGAGCACAGCCTGGATTTTTATTTCTGCCATGAAACCCAGCTCCCATGACTCTCCCAGTCCCTACACTGACT
ACCCTGATCTCTCTTGTCTAGTACGCACATATGCACACAGGCAGACATACCTCCCATCATGACATGGTCCCCAG
GCTGGCCTGAGGATGTCACAGCTTGAGGCTGTGGTGTGAAAGGTGGCCAGCCTGGTTCTCTTCCCTGCTCAGGC
TGCCAGAGAGGTGGTAAATGGCAGAAAGGACATTCCCCCTCCCCTCCCCAGGTGACCTGCTCTCTTTCCTGGGC
CCTGCCCCTCTCCCCACATGTATCCCTCGGTCTGAATTAGACATTCCTGGGCACAGGCTCTTGGGTGCATTGCT
CAGAGTCCCAGGTCCTGGCCTGACCCTCAGGCCCTTCACGTGAGGTCTGTGAGGACCAATTTGTGGGTAGTTCA
TCTTCCCTCGATTGGTTAACTCCTTAGTTTCAGACCACAGACTCAAGATTGGCTCTTCCCAGAGGGCAGCAGAC
AGTCACCCCAAGGCAGGTGTAGGGAGCCCAGGGAGGCCAATCAGCCCCCTGAAGACTCTGGTCCCAGTCAGCCT
GTGGCTTGTGGCCTGTGACCTGTGACCTTCTGCCAGAATTGTCATGCCTCTGAGGCCCCCTCTTACCACACTTT
ACCAGTTAACCACTGAAGCCCCCAATTCCCACAGCTTTTCCATTAAAATGCAAATGGTGGTGGTTCAATCTAAT
CTGATATTGACATATTAGAAGGCAATTAGGGTGTTTCCTTAAACAACTCCTTTCCAAGGATCAGCCCTGAGAGC
AGGTTGGTGACTTTGAGGAGGGCAGTCCTCTGTCCAGATTGGGGTGGGAGCAAGGGACAGGGAGCAGGGCAGGG
GCTGAAAGGGGCACTGATTCAGACCAGGGAGGCAACTACACACCAACATGCTGGCTTTAGAATAAAAGCACCAA
CTGAAAAAA

FIGURE 166

MRGATRVSIMLLLVTVSDCAVITGACERDVQCGAGTCCAISLWLRGLRMCTPLGREGEECHPGSHKVPFFRKRK
HHTCPCLPNLLCSRFPDGRYRCSMDLKNINF

Important feratures:
Signal peptide:
amino acids 1-19

Tyrosine kinase phosphorylation site:
amino acids 88-95

N-myristoylation sites:
amino acids 33-39, 35-41, 46-52

FIGURE 167

```
AACTCAAACTCCTCTCTCTGGGAAAACGCGGTGCTTGCTCCTCCCGGAGTGGCCTTGGCAGGGTGTTGGAGCCC
TCGGTCTGCCCCGTCCGGTCTCTGGGGCCAAGGCTGGGTTTCCCTCATGTATGGCAAGAGCTCTACTCGTGCGG
TGCTTCTTCTCCTTGGCATACAGCTCACAGCTCTTTGGCCTATAGCAGCTGTGGAAATTTATACCTCCCGGGTG
CTGGAGGCTGTTAATGGGACAGATGCTCGGTTAAAATGCACTTTCTCCAGCTTTGCCCCTGTGGGTGATGCTCT
AACAGTGACCTGGAATTTTCGTCCTCTAGACGGGGGACCTGAGCAGTTTGTATTCTACTACCACATAGATCCCT
TCCAACCCATGAGTGGGCGGTTTAAGGACCGGGTGTCTTGGGATGGGAATCCTGAGCGGTACGATGCCTCCATC
CTTCTCTGGAAACTGCAGTTCGACGACAATGGGACATACACCTGCCAGGTGAAGAACCCACCTGATGTTGATGG
GGTGATAGGGGAGATCCGGCTCAGCGTCGTGCACACTGTACGCTTCTCTGAGATCCACTTCCTGGCTCTGGCCA
TTGGCTCTGCCTGTGCACTGATGATCATAATAGTAATTGTAGTGGTCCTCTTCCAGCATTACCGGAAAAAGCGA
TGGGCCGAAAGAGCTCATAAAGTGGTGGAGATAAAATCAAAAGAAGAGGAAAGGCTCAACCAAGAGAAAAAGGT
CTCTGTTTATTTAGAAGACACAGACTAACAATTTTAGATGGAAGCTGAGATGATTTCCAAGAACAAGAACCCTA
GTATTTCTTGAAGTTAATGGAAACTTTTCTTTGGCTTTTCCAGTTGTGACCCGTTTTCCAACCAGTTCTGCAGC
ATATTAGATTCTAGACAAGCAACACCCCTCTGGAGCCAGCACAGTGCTCCTCCATATCACCAGTCATACACAGC
CTCATTATTAAGGTCTTATTTAATTTCAGAGTGTAAATTTTTTCAAGTGCTCATTAGGTTTTATAAACAAGAAG
CTACATTTTTGCCCTTAAGACACTACTTACAGTGTTATGACTTGTATACACATATATTGGTATCAAAGGGGATA
AAAGCCAATTTGTCTGTTACATTTCCTTTCACGTATTTCTTTTAGCAGCACTTCTGCTACTAAAGTTAATGTGT
TTACTCTCTTTCCTTCCCACATTCTCAATTAAAAGGTGAGCTAAGCCTCCTCGGTGTTTCTGATTAACAGTAAA
TCCTAAATTCAAACTGTTAAATGACATTTTTATTTTTATGTCTCTCCTTAACTATGAGACACATCTTGTTTTAC
TGAATTTCTTTCAATATTCCAGGTGATAGATTTTTGTCG
```

FIGURE 168

MYGKSSTRAVLLLLGIQLTALWPIAAVEIYTSRVLEAVNGTDARLKCTFSSFAPVGDALTVTWNFRPLDGGPEQ
FVFYYHIDPFQPMSGRFKDRVSWDGNPERYDASILLWKLQFDDNGTYTCQVKNPPDVDGVIGEIRLSVVHTVRF
SEIHFLALAIGSACALMIIIVIVVVLFQHYRKKRWAERAHKVVEIKSKEEERLNQEKKVSVYLEDTD

FIGURE 169

```
GAGCGAACATGGCAGCGCGTTGGCGGTTTTGGTGTGTCTCTGTGACCATGGTGGTGGCGCTG
CTCATCGTTTGCGACGTTCCCTCAGCCTCTGCCCAAAGAAAGAAGGAGATGGTGTTATCTGA
AAAGGTTAGTCAGCTGATGGAATGGACTAACAAAAGACCTGTAATAAGAATGAATGGAGACA
AGTTCCGTCGCCTTGTGAAAGCCCCACCGAGAAATTACTCCGTTATCGTCATGTTCACTGCT
CTCCAACTGCATAGACAGTGTGTCGTTTGCAAGCAAGCTGATGAAGAATTCCAGATCCTGGC
AAACTCCTGGCGATACTCCAGTGCATTCACCAACAGGATATTTTTTGCCATGGTGGATTTTG
ATGAAGGCTCTGATGTATTTCAGATGCTAAACATGAATTCAGCTCCAACTTTCATCAACTTT
CCTGCAAAAGGGAAACCCAAACGGGGTGATACATATGAGTTACAGGTGCGGGGTTTTCAGC
TGAGCAGATTGCCCGGTGGATCGCCGACAGAACTGATGTCAATATTAGAGTGATTAGACCCC
CAAATTATGCTGGTCCCCTTATGTTGGGATTGCTTTTGGCTGTTATTGGTGGACTTGTGTAT
CTTCGAAGAAGTAATATGGAATTTCTCTTTAATAAAACTGGATGGGCTTTTGCAGCTTTGTG
TTTTGTGCTTGCTATGACATCTGGTCAAATGTGGAACCATATAAGAGGACCACCATATGCCC
ATAAGAATCCCCACACGGGACATGTGAATTATATCCATGGAAGCAGTCAAGCCCAGTTTGTA
GCTGAAACACACATTGTTCTTCTGTTTAATGGTGGAGTTACCTTAGGAATGGTGCTTTTATG
TGAAGCTGCTACCTCTGACATGGATATTGGAAAGCGAAAGATAATGTGTGTGGCTGGTATTG
GACTTGTTGTATTATTCTTCAGTTGGATGCTCTCTATTTTAGATCTAAATATCATGGCTAC
CCATACAGCTTTCTGATGAGTTAAAAAGGTCCCAGAGATATATAGACACTGGAGTACTGGAA
ATTGAAAAACGAAAATCGTGTGTGTTTGAAAAGAAGAATGCAACTTGTATATTTTGTATTAC
CTCTTTTTTTCAAGTGATTTAAATAGTTAATCATTTAACCAAAGAAGATGTGTAGTGCCTTA
ACAAGCAATCCTCTGTCAAAATCTGAGGTATTTGAAAATAATTATCCTCTTAACCTTCTCTT
CCCAGTGAACTTTATGGAACATTTAATTTAGTACAATTAAGTATATTATAAAAATTGTAAAA
CTACTACTTTGTTTTAGTTAGAACAAAGCTCAAAACTACTTTAGTTAACTTGGTCATCTGAT
TTTATATTGCCTTATCCAAAGATGGGGAAAGTAAGTCCTGACCAGGTGTTCCCACATATGCC
TGTTACAGATAACTACATTAGGAATTCATTCTTAGCTTCTTCATCTTTGTGTGGATGTGTAT
ACTTTACGCATCTTTCCTTTTGAGTAGAGAAATTATGTGTGTCATGTGGTCTTCTGAAAATG
GAACACCATTCTTCAGAGCACACGTCTAGCCCTCAGCAAGACAGTTGTTTCTCCTCCTCCTT
GCATATTTCCTACTGCGCTCCAGCCTGAGTGATAGAGTGAGACTCTGTCTCAAAAAAAGTA
TCTCTAAATACAGGATTATAATTTCTGCTTGAGTATGGTGTTAACTACCTTGTATTTAGAAA
GATTTCAGATTCATTCCATCTCCTTAGTTTTCTTTTAAGGTGACCCATCTGTGATAAAAATA
TAGCTTAGTGCTAAAATCAGTGTAACTTATACATGGCCTAAAATGTTTCTACAAATTAGAGT
TTGTCACTTATTCCATTTGTACCTAAGAGAAAAATAGGCTCAGTTAGAAAAGGACTCCCTGG
CCAGGCGCAGTGACTTACGCCTGTAATCTCAGCACTTTGGGAGGCCAAGGCAGGCAGATCAC
GAGGTCAGGAGTTCGAGACCATCCTGGCCAACATGGTGAAACCCCGTCTCTACTAAAAATAT
AAAAATTAGCTGGGTGTGGTGGCAGGAGCCTGTAATCCCAGCTACACAGGAGGCTGAGGCAC
GAGAATCACTTGAACTCAGGAGATGGAGGTTTCAGTGAGCCGAGATCACGCCACTGCACTCC
AGCCTGGCAACAGAGCGAGACTCCATCTCAAAAAAAAAAAAAA
```

FIGURE 170

MAARWRFWCVSVTMVVALLIVCDVPSASAQRKKEMVLSEKVSQLMEWTNKRPVIRMNGDKFR
RLVKAPPRNYSVIVMFTALQLHRQCVVCKQADEEFQILANSWRYSSAFTNRIFFAMVDFDEG
SDVFQMLNMNSAPTFINFPAKGKPKRGDTYELQVRGFSAEQIARWIADRTDVNIRVIRPPNY
AGPLMLGLLLAVIGGLVYLRRSNMEFLFNKTGWAFAALCFVLAMTSGQMWNHIRGPPYAHKN
PHTGHVNYIHGSSQAQFVAETHIVLLFNGGVTLGMVLLCEAATSDMDIGKRKIMCVAGIGLV
VLFFSWMLSIFRSKYHGYPYSFLMS

Signal peptide:
amino acids 1-29

Transmembrane domains:
amino acids 183-205, 217-237, 217-287, 301-321

FIGURE 171

```
CTCCACTGCAACCACCCAGAGCCATGGCTCCCCGAGGCTGCATCGTAGCTGTCTTTGCCATTTTCTGCATCTCC
AGGCTCCTCTGCTCACACGGAGCCCCAGTGGCCCCCATGACTCCTTACCTGATGCTGTGCCAGCCACACAAGAG
ATGTGGGGACAAGTTCTACGACCCCTGCAGCACTGTTGCTATGATGATGCCGTCGTGCCCTTGGCCAGGACCC
AGACGTGTGGAAACTGCACCTTCAGAGTCTGCTTTGAGCAGTGCTGCCCCTGGACCTTCATGGTGAAGCTGATA
AACCAGAACTGCGACTCAGCCCGGACCTCGGATGACAGGCTTTGTCGCAGTGTCAGCTAATGGAACATCAGGGG
AACGATGACTCCTGGATTCTCCTTCCTGGGTGGGCCTGGAGAAAGAGGCTGGTGTTACCTGAGATCTGGGATGC
TGAGTGGCTGTTTGGGGGCCAGAGAAACACACACTCAACTGCCCACTTCATTCTGTGACCTGTCTGAGGCCCAC
CCTGCAGCTGCCCTGAGGAGGCCCACAGGTCCCCTTCTAGAATTCTGGACAGCATGAGATGCGTGTGCTGATGG
GGGCCCAGGGACTCTGAACCCTCCTGATGACCCCTATGGCCAACATCAACCCGGCACCACCCCAAGGCTGGCTG
GGGAACCCTTCACCCTTCTGTGAGATTTTCCATCATCTCAAGTTCTCTTCTATCCAGGAGCAAAGCACAGGATC
ATAATAAATTTATGTACTTTATAAATGAAAA
```

FIGURE 172

MAPRGCIVAVFAIFCISRLLCSHGAPVAPMTPYLMLCQPHKRCGDKFYDPLQHCCYDDAVVPLARTQTCGNCTF
RVCFEQCCPWTFMVKLINQNCDSARTSDDRLCRSVS

Important features:
Signal peptide:
amino acids 1-24

FIGURE 173

```
GGGGGCGGGTGCCTGGAGCACGGCGCTGGGGCCGCCCGCAGCGCTCACTCGCTCGCACTCAG
TCGCGGGAGGCTTCCCCGCGCCGGCCGCGTCCCGCCCGCTCCCCGGCACCAGAAGTTCCTCT
GCGCGTCCGACGGCGACATGGGCGTCCCCACGGCCCTGGAGGCCGGCAGCTGGCGCTGGGGA
TCCCTGCTCTTCGCTCTCTTCCTGGCTGCGTCCCTAGGTCCGGTGGCAGCCTTCAAGGTCGC
CACGCCGTATTCCCTGTATGTCTGTCCCGAGGGGCAGAACGTCACCCTCACCTGCAGGCTCT
TGGGCCCTGTGGACAAAGGGCACGATGTGACCTTCTACAAGACGTGGTACCGCAGCTCGAGG
GGCGAGGTGCAGACCTGCTCAGAGCGCCGGCCCATCCGCAACCTCACGTTCCAGGACCTTCA
CCTGCACCATGGAGGCCACCAGGCTGCCAACACCAGCCACGACCTGGCTCAGCGCCACGGGC
TGGAGTCGGCCTCCGACCACCATGGCAACTTCTCCATCACCATGCGCAACCTGACCCTGCTG
GATAGCGGCCTCTACTGCTGCCTGGTGGTGGAGATCAGGCACCACCACTCGGAGCACAGGGT
CCATGGTGCCATGGAGCTGCAGGTGCAGACAGGCAAAGATGCACCATCCAACTGTGTGGTGT
ACCCATCCTCCTCCCAGGATAGTGAAAACATCACGGCTGCAGCCCTGGCTACGGGTGCCTGC
ATCGTAGGAATCCTCTGCCTCCCCCTCATCCTGCTCCTGGTCTACAAGCAAAGGCAGGCAGC
CTCCAACCGCCGTGCCCAGGAGCTGGTGCGGATGGACAGCAACATTCAAGGGATTGAAAACC
CCGGCTTTGAAGCCTCACCACCTGCCCAGGGGATACCCGAGGCCAAAGTCAGGCACCCCCTG
TCCTATGTGGCCCAGCGGCAGCCTTCTGAGTCTGGGCGGCATCTGCTTTCGGAGCCCAGCAC
CCCCCTGTCTCCTCCAGGCCCCGGAGACGTCTTCTTCCCATCCCTGGACCCTGTCCCTGACT
CTCCAAACTTTGAGGTCATCTAGCCCAGCTGGGGACAGTGGGCTGTTGTGGCTGGGTCTGG
GGCAGGTGCATTTGAGCCAGGGCTGGCTCTGTGAGTGGCCTCCTTGGCCTCGGCCCTGGTTC
CCTCCCTCCTGCTCTGGGCTCAGATACTGTGACATCCCAGAAGCCCAGCCCCTCAACCCCTC
TGGATGCTACATGGGGATGCTGGACGGCTCAGCCCCTGTTCCAAGGATTTTGGGGTGCTGAG
ATTCTCCCCTAGAGACCTGAAATTCACCAGCTACAGATGCCAAATGACTTACATCTTAAGAA
GTCTCAGAACGTCCAGCCCTTCAGCAGCTCTCGTTCTGAGACATGAGCCTTGGGATGTGGCA
GCATCAGTGGGACAAGATGGACACTGGGCCACCCTCCCAGGCACCAGACACAGGGCACGGTG
GAGAGACTTCTCCCCCGTGGCCGCCTTGGCTCCCCGTTTTGCCCGAGGCTGCTCTTCTGTC
AGACTTCCTCTTTGTACCACAGTGGCTCTGGGGCCAGGCCTGCCTGCCCACTGGCCATCGCC
ACCTTCCCCAGCTGCCTCCTACCAGCAGTTTCTCTGAAGATCTGTCAACAGGTTAAGTCAAT
CTGGGGCTTCCACTGCCTGCATTCCAGTCCCCAGAGCTTGGTGGTCCCGAAACGGGAAGTAC
ATATTGGGGCATGGTGGCCTCCGTGAGCAAATGGTGTCTTGGGCAATCTGAGGCCAGGACAG
ATGTTGCCCCACCCACTGGAGATGGTGCTGAGGGAGGTGGGTGGGGCCTTCTGGGAAGGTGA
GTGGAGAGGGGCACCTGCCCCCCGCCCTCCCCATCCCCTACTCCCACTGCTCAGCGCGGGCC
ATTGCAAGGGTGCCACACAATGTCTTGTCCACCCTGGGACACTTCTGAGTATGAAGCGGGAT
GCTATTAAAAACTACATGGGGAAAAAAAAAAAAAAAAAAAAAAAAAAAAAAAAAAAAGA
```

FIGURE 174

```
></usr/seqdb2/sst/DNA/Dnaseqs.min/ss.DNA64897
><subunit 1 of 1, 311 aa, 1 stop
><MW: 33908, pI: 6.87, NX(S/T): 6
MGVPTALEAGSWRWGSLLFALFLAASLGPVAAFKVATPYSLYVCPEGQNVTLTCRLLGPVDK
GHDVTFYKTWYRSSRGEVQTCSERRPIRNLTFQDLHLHHGGHQAANTSHDLAQRHGLESASD
HHGNFSITMRNLTLLDSGLYCCLVVEIRHHHSEHRVHGAMELQVQTGKDAPSNCVVYPSSSQ
DSENITAAALATGACIVGILCLPLILLLVYKQRQAASNRRAQELVRMDSNIQGIENPGFEAS
PPAQGIPEAKVRHPLSYVAQRQPSESCRHLLSEPSTPLSPPGPGDVFFPSLDPVPDSPNFEVI
```

Signal peptide:
amino acids 1-28

Transmembrane domain:
amino acids 190-216

FIGURE 175

```
CTAGCCTGCGCCAAGGGGTAGTGAGACCGCGCGGCAACAGCTTGCGGCTGCGGGGAGCTCCCGTGGGCGCTCCG
CTGGCTGTGCAGGCGGCCATGGATTCCTTGCGGAAAATGCTGATCTCAGTCGCAATGCTGGGCGCAGGGGCTGG
CGTGGGCTACGCGCTCCTCGTTATCGTGACCCCGGGAGAGCGGCGGAAGCAGGAAATGCTAAAGGAGATGCCAC
TGCAGGACCCAAGGAGCAGGGAGGAGGCGGCCAGGACCCAGCAGCTATTGCTGGCCACTCTGCAGGAGGCAGCG
ACCACGCAGGAGAACGTGGCCTGGAGGAAGAACTGGATGGTTGGCGGCGAAGGCGGCGCCAGCGGGAGGTCACC
GTGAGACCGGACTTGCCTCCGTGGGCGCCGGACCTTGGCTTGGGCGCAGGAATCCGAGGCAGCCTTTCTCCTTC
GTGGGCCCAGCGGAGAGTCCGGACCGAGATACCATGCCAGGACTCTCCGGGGTCCTGTGAGCTGCCGTCGGGTG
AGCACGTTTCCCCCAAACCCTGGACTGACTGCTTTAAGGTCCGCAAGGCGGGCCAGGGCCGAGACGCGAGTCGG
ATGTGGTGAACTGAAAGAACCAATAAAATCATGTTCCTCCAAAAAAAAAAAAAAAAAAAAAAAAAAAAAAAAAA
AAAAAAAAAAAAAAAAAAAAAAAAAA
```

FIGURE 176

MDSLRKMLISVAMLGAGAGVGYALLVIVTPGERRKQEMLKEMPLQDPRSREEAARTQQLLLATLQEAATTQENV
AWRKNWMVGGEGGASGRSP

Important features:
Signal peptide:
amino acids 1-18

FIGURE 177

```
GCCAGGCAGGTGGGCCTCAGGAGGTGCCTCCAGGCGGCCAGTGGGCCTGAGGCCCCAGCAAG
GGCTAGGGTCCATCTCCAGTCCCAGGACACAGCAGCGGCCACCATGGCCACGCCTGGGCTCC
AGCAGCATCAGAGCAGCCCCTGTGGTTGGCAGCAAAGTTCAGCTTGGCTGGGCCCGCTGTGA
GGGGCTTCGCGCTACGCCCTGCGGTGTCCCGAGGGCTGAGGTCTCCTCATCTTCTCCCTAGC
AGTGGATGAGCAACCCAACGGGGGCCCGGGGAGGGAACTGGCCCCGAGGGAGAGGAACCCC
AAAGCCACATCTGTAGCCAGGATGAGCAGTGTGAATCCAGGCAGCCCCCAGGACCGGGGAGG
CACAGGTGGCCCCCACCACCCGGAGGAGCAGCTCCTGCCCCTGTCCGGGGGATGACTGATTC
TCCTCCGCCAGGCCACCCAGAGGAGAAGGCCACCCCGCCTGGAGGCACAGGCCATGAGGGGC
TCTCAGGAGGTGCTGCTGATGTGGCTTCTGGTGTTGGCAGTGGGCGGCACAGAGCACGCCTA
CCGGCCCGGCCGTAGGGTGTGTGCTGTCCGGGCTCACGGGGACCCTGTCTCCGAGTCGTTCG
TGCAGCGTGTGTACCAGCCCTTCCTCACCACCTGCGACGGGCACCGGGCCTGCAGCACCTAC
CGAACCATCTATAGGACCGCCTACCGCCGCAGCCCTGGGCTGGCCCCTGCCAGGCCTCGCTA
CGCGTGCTGCCCCGGCTGGAAGAGGACCAGCGGGCTTCCTGGGGCCTGTGGAGCAGCAATAT
GCCAGCCGCCATGCCGGAACGGAGGGAGCTGTGTCCAGCCTGGCCGCTGCCGCTGCCCTGCA
GGATGGCGGGGTGACACTTGCCAGTCAGATGTGGATGAATGCAGTGCTAGGAGGGGCGGCTG
TCCCCAGCGCTGCATCAACACCGCCGGCAGTTACTGGTGCCAGTGTTGGGAGGGGCACAGCC
TGTCTGCAGACGGTACACTCTGTGTGCCCAAGGGAGGGCCCCCAGGGTGGCCCCCAACCCG
ACAGGAGTGGACAGTGCAATGAAGGAAGAAGTGCAGAGGCTGCAGTCCAGGGTGGACCTGCT
GGAGGAGAAGCTGCAGCTGGTGCTGGCCCCACTGCACAGCCTGGCCTCGCAGGCACTGGAGC
ATGGGCTCCCGGACCCCGGCAGCCTCCTGGTGCACTCCTTCCAGCAGCTCGGCCGCATCGAC
TCCCTGAGCGAGCAGATTTCCTTCCTGGAGGAGCAGCTGGGGTCCTGCTCCTGCAAGAAAGA
CTCGTGACTGCCCAGCGCTCCAGGCTGGACTGAGCCCCTCACGCCGCCCTGCAGCCCCCATG
CCCCTGCCCAACATGCTGGGGGTCCAGAAGCCACCTCGGGGTGACTGAGCGGAAGGCCAGGC
AGGGCCTTCCTCCTCTTCCTCCTCCCCTTCCTCGGGAGGCTCCCCAGACCCTGGCATGGGAT
GGGCTGGGATCTTCTCTGTGAATCCACCCCTGGCTACCCCCACCCTGGCTACCCCAACGGCA
TCCCAAGGCCAGGTGGACCCTCAGCTGAGGGAAGGTACGAGCTCCCTGCTGGAGCCTGGGAC
CCATGGCACAGGCCAGGCAGCCCGGAGGCTGGGTGGGGCCTCAGTGGGGCTGCTGCCTGAC
CCCCAGCACAATAAAAATGAAACGTG
```

FIGURE 178

MRGSQEVLLMWLLVLAVGGTEHAYRPGRRVCAVRAHGDPVSESFVQRVYQPFLTTCDGHRAC
STYRTIYRTAYRRSPGLAPARPRYACCPGWKRTSGLPGACGAAICQPPCRNGGSCVQPGRCR
CPAGWRGDTCQSDVDECSARRGGCPQRCINTAGSYWCQCWEGHSLSADGTLCVPKGGPPRVA
PNPTGVDSAMKEEVQRLQSRVDLLEEKLQLVLAPLHSLASQALEHGLPDPGSLLVHSFQQLG
RIDSLSEQISFLEEQLGSCSCKKDS

Signal sequence:
1-19

FIGURE 179

```
GACAGCTGTGTCTCGATGGAGTAGACTCTCAGAACAGCGCAGTTTGCCCTCCGCTCACGCAG
AGCCTCTCCGTGGCTTCCGCACCTTGAGCATTAGGCCAGTTCTCCTCTTCTCTCTAATCCAT
CCGTCACCTCTCCTGTCATCCGTTTCCATGCCGTGAGGTCCATTCACAGAACACATCCATGG
CTCTCATGCTCAGTTTGGTTCTGAGTCTCCTCAAGCTGGGATCAGGGCAGTGGCAGGTGTTT
GGGCCAGACAAGCCTGTCCAGGCCTTGGTGGGGAGGACGCAGCATTCTCCTGTTTCCTGTC
TCCTAAGACCAATGCAGAGGCCATGGAAGTGCGGTTCTTCAGGGGCCAGTTCTCTAGCGTGG
TCCACCTCTACAGGGACGGGAAGGACCAGCCATTTATGCAGATGCCACAGTATCAAGGCAGG
ACAAAACTGGTGAAGGATTCTATTGCGGAGGGCGCATCTCTCTGAGGCTGGAAAACATTAC
TGTGTTGGATGCTGGCCTCTATGGGTGCAGGATTAGTTCCCAGTCTTACTACCAGAAGGCCA
TCTGGGAGCTACAGGTGTCAGCACTGGGCTCAGTTCCTCTCATTTCCATCACGGGATATGTT
GATAGAGACATCCAGCTACTCTGTCAGTCCTCGGGCTGGTTCCCCCGGCCCACAGCGAAGTG
GAAAGGTCCACAAGGACAGGATTTGTCCACAGACTCCAGGACAAACAGAGACATGCATGGCC
TGTTTGATGTGGAGATCTCTCTGACCGTCCAAGAGAACGCCGGGAGCATATCCTGTTCCATG
CGGCATGCTCATCTGAGCCGAGAGGTGGAATCCAGGGTACAGATAGGAGATACCTTTTCGA
GCCTATATCGTGGCACCTGGCTACCAAAGTACTGGGAATACTCTGCTGTGGCCTATTTTTG
GCATTGTTGGACTGAAGATTTTCTTCTCCAAATTCCAGTGGAAAATCCAGGCGGAACTGGAC
TGGAGAAGAAAGCACGGACAGGCAGAATTGAGAGACGCCCGGAAACACGCAGTGGAGGTGAC
TCTGGATCCAGAGACGGCTCACCCGAAGCTCTGCGTTTCTGATCTGAAAACTGTAACCCATA
GAAAAGCTCCCCAGGAGGTGCCTCACTCTGAGAAGAGATTTACAAGGAAGAGTGTGGTGGCT
TCTCAGAGTTTCCAAGCAGGGAAACATTACTGGGAGGTGGACGGAGGACACAATAAAAGGTG
GCGCGTGGGAGTGTGCCGGGATGATGTGGACAGGAGGAAGGAGTACGTGACTTTGTCTCCCG
ATCATGGGTACTGGGTCCTCAGACTGAATGGAGAACATTTGTATTTCACATTAAATCCCCGT
TTTATCAGCGTCTTCCCCAGGACCCCACCTACAAAAATAGGGGTCTTCCTGGACTATGAGTG
TGGGACCATCTCCTTCTTCAACATAAATGACCAGTCCCTTATTTATACCCTGACATGTCGGT
TTGAAGGCTTATTGAGGCCCTACATTGAGTATCCGTCCTATAATGAGCAAAATGGAACTCCC
ATAGTCATCTGCCCAGTCACCCAGGAATCAGAGAAAGAGGCCTCTTGGCAAAGGGCCTCTGC
AATCCCAGAGACAAGCAACAGTGAGTCCTCCTCACAGGCAACCACGCCCTTCCTCCCCAGGG
GTGAAATGTAGGATGAATCACATCCCACATTCTTCTTTAGGGATATTAAGGTCTCTCTCCCA
GATCCAAAGTCCCGCAGCAGCCGGCCAAGGTGGCTTCCAGATGAAGGGGGACTGGCCTGTCC
ACATGGGAGTCAGGTGTCATGGCTGCCCTGAGCTGGGAGGGAAGAAGGCTGACATTACATTT
AGTTTGCTCTCACTCCATCTGGCTAAGTGATCTTGAAATACCACCTCTCAGGTGAAGAACCG
TCAGGAATTCCCATCTCACAGGCTGTGGTGTAGATTAAGTAGACAAGGAATGTGAATAATGC
TTAGATCTTATTGATGACAGAGTGTATCCTAATGGTTTGTTCATTATATTACACTTTCAGTA
AAAAAA
```

FIGURE 180

MALMLSLVLSLLKLGSGQWQVFGPDKPVQALVGEDAAFSCFLSPKTNAEAMEVRFFRGQFSS
VVHLYRDGKDQPFMQMPQYQGRTKLVKDSIAEGRISLRLENITVLDAGLYGCRISSQSYYQK
AIWELQVSALGSVPLISITGYVDRDIQLLCQSSGWFPRPTAKWKGPQGQDLSTDSRTNRDMH
GLFDVEISLTVQENAGSISCSMRHAHLSREVESRVQIGDTFFEPISWHLATKVLGILCCGLF
FGIVGLKIFFSKFQWKIQAELDWRRKHGQAELRDARKHAVEVTLDPETAHPKLCVSDLKTVT
HRKAPQEVPHSEKRFTRKSVVASQSFQAGKHYWEVDGGHNKRWRVGVCRDDVDRRKEYVTLS
PDHGYWVLRLNGEHLYFTLNPRFISVFPRTPPTKIGVFLDYECGTISFFNINDQSLIYTLTC
RFEGLLRPYIEYPSYNEQNGTPIVICPVTQESEKEASWQRASAIPETSNSESSSQATTPFLP
RGEM

Signal peptide:
amino acids 1-17

Transmembrane domain:
amino acids 239-255

FIGURE 181

```
GCGATGGTGCGCCCGGTGGCGGTGGCGGCGGCGGTTGCGGAGGCTTCCTTGGTCGGATTGCAACGAGGAGAAGA
TGACTGACCAACCGACTGGCTGAATGAATGAATGGCGGAGCCGAGCGCGCCATGAGGAGCCTGCCGAGCCTGGG
CGGCCTCGCCCTGTTGTGCTGCGCCGCCGCCGCCGCCGTCGCCTCAGCCGCCTCGGCGGGGAATGTCACCG
GTGGCGGCGGGGCCGCGGGGCAGGTGGACGCGTCGCCGGGCCCCGGGTTGCGGGGCGAGCCCAGCCACCCCTTC
CCTAGGGCGACGGCTCCCACGGCCCAGGCCCCGAGGACCGGGCCCCCGCGCGCCACCGTCCACCGACCCCTGGC
TGCGACTTCTCCAGCCCAGTCCCCGGAGACCACCCCTCTTTGGGCGACTGCTGGACCCTCTTCCACCACCTTTC
AGGCGCCGCTCGGCCCCTCGCCGACCACCCCTCCGGCGGCGGAACGCACTTCGACCACCTCTCAGGCGCCGACC
AGACCCGCGCCGACCACCCTTTCGACGACCACTGGCCCGGCGCCGACCACCCCTGTAGCGACCACCGTACCGGC
GCCCACGACTCCCCGGACCCCGACCCCCGATCTCCCCAGCAGCAGCAACAGCAGCGTCCTCCCCACCCCACCTG
CCACCGAGGCCCCCTCTTCGCCTCCTCCAGAGTATGTATGTAACTGCTCTGTGGTTGGAAGCCTGAATGTGAAT
CGCTGCAACCAGACCACAGGGCAGTGTGAGTGTCGGCCAGGTTATCAGGGGCTTCACTGTGAAACCTGCAAAGA
GGGCTTTTACCTAAATTACACTTCTGGGCTCTGTCAGCCATGTGACTGTAGTCCACATGGAGCTCTCAGCATAC
CGTGCAACAGGTAAGCAACAGAGGGTGGAACTGAAGTTTATTTTATTTTAGCAAGGGAAAAAAAAAGGCTGCTA
CTCTCAAGGACCATACTGGTTTAAACAAAGGAGGATGAGGGTCATAGATTTACAAAATATTTTATATACTTTTA
TTCTCTTACTTTATATGTTATATTTAATGTCAGGATTTAAAAACATCTAATTTACTGATTTAGTTCTTCAAAAG
CACTAGAGTCGCCAATTTTTCTCTGGGATAATTTCTGTAAATTTCATGGGAAAAAATTATTGAAGAATAAATCT
GCTTTCTGGAAGGGCTTTCAGGCATGAAACCTGCTAGGAGGTTTAGAAATGTTCTTATGTTTATTAATATACCA
TTGGAGTTTGAGGAAATTTGTTGTTTGGTTTATTTTTCTCTCTAATCAAAATTCTACATTTGTTTCTTTGGACA
TCTAAAGCTTAACCTGGGGGTACCCTAATTTATTTAACTAGTGGTAAGTAGACTGGTTTTACTCTATTTACCAG
TACATTTTGAGACCAAAAGTAGATTAAGCAGGAATTATCTTTAAACTATTATGTTATTTGGAGGTAATTTAAT
CTAGTGGAATAATGTACTGTTATCTAAGCATTTGCCTTGTACTGCACTGAAAGTAATTATTCTTTGACCTTATG
TGAGGCACTTGGCTTTTTGTGGACCCCAAGTCAAAAAACTGAAGAGACAGTATTAAATAATGAAAAAAATAATG
ACAGGTTATACTCAGTGTAACCTGGGTATAACCCAAGATCTGCTGCCACTTACGAGCTGTGTTCCTTGGGCAAG
TAATTTCCTTTCACTGAGCTTGTTTCTTCTCAAGGTTGTTGTGAAGATTAAATGAGTTGATATATATAAAATGC
CTAGCACATGTCACTCAATAAATTCTGGTTTGTTTTAATTTCAAAGGAATATTATGGACTGAAATGAGAGAACA
TGTTTTAAGAACTTTTAGCTCCTTGACAAAGAAGTGCTTTATACTTTAGCACTAAATATTTAAATGCTTTATA
AATGATATTATACTGTTATGGAATATTGTATCATATTGTAGTTTATTAAAAATGTAGAAGAGGCTGGGCGCGGT
GGCTCACGCCTGTAATCCTAGCACTTTGGGAGGCCAAGGCGGGTGGATCACTTGAGGCCAGGAGTTCTAGATGA
GCCTGGCCAGCACAGTGAAACCCGTCTCTACTAAAAATACAAACAAATTAGCTGGGCGTGGTGGCACACACCT
GTAGTCCCAGCTACTCGGGAGGCTGAGGCAGGAGAATCGGTTGAACCCGGGAGGTGGAGGTTGCAGTGAGCTGA
GATCGCGCCACTGCACTCCAGCCTGGTGAGAGAGGGAGACTCTGTCTTAAAAAAAAAAAAAAAAAAAAAAAAAAA
```

FIGURE 182

```
></usr/seqdb2/sst/DNA/Dnaseqs.min/ss.DNA64952
><subunit 1 of 1, 258 aa, 1 stop
><MW: 25716, pI: 8.13, NX(S/T): 5
MRSLPSLGGLALLCCAAAAAAVASAASAGNVTGGGGAAGQVDASPGPGLRGEPSHPFPRATA
PTAQAPRTGPPRATVHRPLAATSPAQSPETTPLWATAGPSSTTFQAPLGPSPTTPPAAERTS
TTSQAPTRPAPTTLSTTTGPAPTTPVATTVPAPTTPRTPTPDLPSSSNSSVLPTPPATEAPS
SPPPEYVCNCSVVGSLNVNRCNQTTGQCECRPGYQGLHCETCKEGFYLNYTSGLCQPCDCSP
HGALSIPCNR
```

Important features of the protein:
Signal peptide:
amino acids 1-25

N-glycosylation sites.
amino acids 30-33, 172-175, 195-198, 208-211, 235-238

EGF-like domain cysteine pattern signature.
amino acids 214-226.

FIGURE 183

```
TGCGGCGCAGTGTAGACCTGGGAGGATGGGCGGCCTGCTGCTGGCTGCTTTTCTGGCTTTGGTCTCGGTGCCCA
GGGCCCAGGCCGTGTGGTTGGGAAGACTGGACCCTGAGCAGCTTCTTGGGCCCTGGTACGTGCTTGCGGTGGCC
TCCCGGGAAAAGGGCTTTGCCATGGAGAAGGACATGAAGAACGTCGTGGGGGTGGTGGTGACCCTCACTCCAGA
AAACAACCTGCGGACGCTGTCCTCTCAGCACGGGCTGGGAGGGTGTGACCAGAGTGTCATGGACCTGATAAAGC
GAAACTCCGGATGGGTGTTTGAGAATCCCTCAATAGGCGTGCTGGAGCTCTGGGTGCTGGCCACCAACTTCAGA
GACTATGCCATCATCTTCACTCAGCTGGAGTTCGGGGACGAGCCCTTCAACACCGTGGAGCTGTACAGTCTCAC
GGAGACAGCCAGCCAGGAGGCCATGGGGCTCTTCACCAACTGGAGCAGGAGCCTGGGCTTCCTGTCACAGTAGC
AGGCCCAGCTGCAGAAGGACCTCACCTGTGCTCACAAGATCCTTCTGTGAGTGCTGCGTCCCCAGTAGGGATGG
CGCCCACAGGGTCCTGTGACCTCGGCCAGTGTCCACCCACCTCGCTCAGCGGCTCCCGGGGCCCAGCACCAGCT
CAGAATAAAGCGATTCCACAGCA
```

FIGURE 184

MGGLLLAAFLALVSVPRAQAVWLGRLDPEQLLGPWYVLAVASREKGFAMEKDMKNVVGVVVTLTPENNLRTLSS
QHGLGGCDQSVMDLIKRNSGWVFENPSIGVLELWVLATNFRDYAIIFTQLEFGDEPFNTVELYSLTETASQEAM
GLFTKWSRSLGFLSQ

Important features:
Signal peptide:
amino acids 1-20

FIGURE 185

```
GTTCCGCAGATGCAGAGGTTGAGGTGGCTGCGGGACTGGAAGTCATCGGGCAGAGGTCTCACAGCAGCCAAGGA
ACCTGGGGCCCGCTCCTCCCCCCTCCAGGCCATGAGGATTCTGCAGTTAATCCTGCTTGCTCTGGCAACAGGGC
TTGTAGGGGGAGAGACCAGGATCATCAAGGGGTTCGAGTGCAAGCCTCACTCCCAGCCCTGGCAGGCAGCCCTG
TTCGAGAAGACGCGGCTACTCTGTGGGGCGACGCTCATCGCCCCCAGATGGCTCCTGACAGCAGCCCACTGCCT
CAAGCCCCGCTACATAGTTCACCTGGGGCAGCACAACCTCCAGAAGGAGGAGGGCTGTGAGCAGACCCGGACAG
CCACTGAGTCCTTCCCCCACCCCGGCTTCAACAACAGCCTCCCCAACAAAGACCACCGCAATGACATCATGCTG
GTGAAGATGGCATCGCCAGTCTCCATCACCTGGGCTGTGCGACCCCTCACCCTCTCCTCACGCTGTGTCACTGC
TGGCACCAGCTGCCTCATTTCCGGCTGGGGCAGCACGTCCAGCCCCCAGTTACGCCTGCCTCACACCTTGCGAT
GCGCCAACATCACCATCATTGAGCACCAGAAGTGTGAGAACGCCTACCCCGGCAACATCACAGACACCATGGTG
TGTGCCAGCGTGCAGGAAGGGGGCAAGGACTCCTGCCAGGGTGACTCCGGGGGCCCTCTGGTCTGTAACCAGTC
TCTTCAAGGCATTATCTCCTGGGGCCAGGATCCGTGTGCGATCACCCGAAAGCCTGGTGTCTACACGAAAGTCT
GCAAATATGTGGACTGGATCCAGGAGACGATGAAGAACAATTAGACTGGACCCACCCACCACAGCCCATCACCC
TCCATTTCCACTTGGTGTTTGGTTCCTGTTCACTCTGTTAATAAGAAACCCTAAGCCAAGACCCTCTACGAACA
TTCTTTGGGCCTCCTGGACTACAGGAGATGCTGTCACTTAATAATCAACCTGGGGTTCGAAATCAGTGAGACCT
GGATTCAAATTCTGCCTTGAAATATTGTGACTCTGGGAATGACAACACCTGGTTTGTTCTCTGTTGTATCCCCA
GCCCCAAAGACAGCTCCTGGCCATATATCAAGGTTTCAATAAATATTTGCTAAATGAAAAAAAAAAAAAAAAAA
AAAAAAAAAAAAAAAAAAAA
```

FIGURE 186

MRILQLILLALATGLVGGETRIIKGFECKPHSQPWQAALFEKTRLLCGATLIAPRWLLTAAHCLKPRYIVHLGQ
HNLQKEEGCEQTRTATESFPHPGFNNSLPNKDHRNDIMLVKMASPVSITWAVRPLTLSSRCVTAGTSCLISGWG
STSSPQLRLPHTLRCANITIIEHQKCENAYPGNITDTMVCASVQEGGKDSCQGDSGGPLVCNQSLQGIISWGQD
PCAITRKPGVYTKVCKYVDWIQETMKNN

Important features:
Signal peptide:
amino acids 1-18

Serine proteases, trypsin family, histidine active site.
amino acids 58-63

N-glycosylation sites.
amino acids 99-102, 165-168, 181-184, 210-213

Glycosaminoglycan attachment site.
amino acids 145-148

Kringle domain proteins.
amino acids 197-209, 47-64

Serine proteases, trypsin family, histidine protein
amino acids 199-209, 47-63, 220-243

Apple domain proteins
amino acids 222-249, 189-222

FIGURE 187

```
GCTCAAGTGCCCTGCCTTGCCCCACCCAGCCCAGCCTGGCCAGAGCCCCCTGGAGAAGGAGC
TCTCTTCTTGCTTGGCAGCTGGACCAAGGGAGCCAGTCTTGGGCGCTGGAGGGCCTGTCCTG
ACCATGGTCCCTGCCTGGCTGTGGCTGCTTTGTGTCTCCGTCCCCCAGGCTCTCCCCAAGGC
CCAGCCTGCAGAGCTGTCTGTGGAAGTTCCAGAAAACTATGGTGGAAATTTCCCTTTATACC
TGACCAAGTTGCCGCTGCCCCGTGAGGGGCTGAAGGCCAGATCGTGCTGTCAGGGGACTCA
GGCAAGGCAACTGAGGGCCCATTTGCTATGGATCCAGATTCTGGCTTCCTGCTGGTGACCAG
GGCCCTGGACCGAGAGGAGCAGGCAGAGTACCAGCTACAGGTCACCCTGGAGATGCAGGATG
GACATGTCTTGTGGGGTCCACAGCCTGTGCTTGTGCACGTGAAGGATGAGAATGACCAGGTG
CCCCATTTCTCTCAAGCCATCTACAGAGCTCGGCTGAGCCGGGGTACCAGGCCTGGCATCCC
CTTCCTCTTCCTTGAGGCTTCAGACCGGGATGAGCCAGGCACAGCCAACTCGGATCTTCGAT
TCCACATCCTGAGCCAGGCTCCAGCCCAGCCTTCCCCAGACATGTTCCAGCTGGAGCCTCGG
CTGGGGGCTCTGGCCCTCAGCCCCAAGGGGAGCACCAGCCTTGACCACGCCCTGGAGAGGAC
CTACCAGCTGTTGGTACAGGTCAAGGACATGGGTGACCAGGCCTCAGGCCACCAGGCCACTG
CCACCGTGGAAGTCTCCATCATAGAGAGCACCTGGGTGTCCCTAGAGCCTATCCACCTGGCA
GAGAATCTCAAAGTCCTATACCCGCACCACATGGCCCAGGTACACTGGAGTGGGGGTGATGT
GCACTATCACCTGGAGAGCCATCCCCCGGGACCCTTTGAAGTGAATGCAGAGGGAAACCTCT
ACGTGACCAGAGAGCTGGACAGAGAAGCCCAGGCTGAGTACCTGCTCCAGGTGCGGGCTCAG
AATTCCCATGGCGAGGACTATGCGGCCCCTCTGGAGCTGCACGTGCTGGTGATGGATGAGAA
TGACAACGTGCCTATCTGCCCTCCCCGTGACCCCACAGTCAGCATCCCTGAGCTCAGTCCAC
CAGGTACTGAAGTGACTAGACTGTCAGCAGAGGATGCAGATGCCCCCGGCTCCCCCAATTCC
CACGTTGTGTATCAGCTCCTGAGCCCTGAGCCTGAGGATGGGGTAGAGGGGAGAGCCTTCCA
GGTGGACCCCACTTCAGGCAGTGTGACGCTGGGGGTGCTCCCACTCCGAGCAGGCCAGAACA
TCCTGCTTCTGGTGCTGGCCATGGACCTGGCAGGCGCAGAGGGTGGCTTCAGCAGCACGTGT
GAAGTCGAAGTCGCAGTCACAGATATCAATGATCACGCCCCTGAGTTCATCACTTCCCAGAT
TGGGCCTATAAGCCTCCCTGAGGATGTGGAGCCCGGGACTCTGGTGGCCATGCTAACAGCCA
TTGATGCTGACCTCGAGCCCGCCTTCCGCCTCATGGATTTTGCCATTGAGAGGGGAGACACA
GAAGGGACTTTTGGCCTGGATTGGGAGCCAGACTCTGGGCATGTTAGACTCAGACTCTGCAA
GAACCTCAGTTATGAGGCAGCTCCAAGTCATGAGGTGGTGGTGGTGGTGCAGAGTGTGGCGA
AGCTGGTGGGGCCAGGCCCAGGCCCTGGAGCCACCGCCACGGTGACTGTGCTAGTGGAGAGA
GTGATGCCACCCCCCAAGTTGGACCAGGAGAGCTACGAGGCCAGTGTCCCCATCAGTGCCCC
AGCCGGCTCTTTCCTGCTGACCATCCAGCCCTCCGACCCCATCAGCCGAACCCTCAGGTTCT
CCCTAGTCAATGACTCAGAGGGCTGGCTCTGCATTGAGAAATTCTCCGGGGACGTGCACACC
GCCCAGTCCCTGCAGGGCGCCCAGCCTGGGGACACCTACACGGTGCTTGTGGAGCCCAGGA
TACAGCCCTGACTCTTGCCCCTGTGCCCTCCCAATACCTCTGCACACCCCGCCAAGACCATG
GCTTGATCGTGAGTGGACCCAGCAAGGACCCCGATCTGGCCAGTGGGCACGGTCCCTACAGC
TTCACCCTTGGTCCCAACCCCACGGTGCAACGGGATTGGCGCCTCCAGACTCTCAATGGTTC
CCATGCCTACCTCACCTTGGCCCTGCATTGGGTGGAGCCACGTGAACACATAATCCCCGTGG
TGGTCAGCCACAATGCCCAGATGTGGCAGCTCCTGGTTCGAGTGATCGTGTGTCGCTGCAAC
GTGGAGGGGCAGTGCATGCGCAAGGTGGGCCGCATGAAGGGCATGCCCACGAAGCTGTCGGC
AGTGGGCATCCTTGTAGGCACCCTGGTAGCAATAGGAATCTTCCTCATCCTCATTTTCACCC
ACTGGACCATGTCAAGGAAGAAGGACCCGGATCAACCAGCAGACAGCGTGCCCCTGAAGGCG
ACTGTCTGAATGGCCCAGGCAGCTCTAGCTGGGAGCTTGGCCTCTGGCTCCATCTGAGTCCC
CTGGGAGAGAGCCCAGCACCCAAGATCCAGCAGGGGACAGGACAGAGTAGAAGCCCCTCCAT
CTGCCCTGGGGTGGAGGCACCATCACCATCACCAGGCATGTCTGCAGAGCCTGGACACCAAC
TTTATGGACTGCCCATGGGAGTGCTCCAAATGTCAGGGTGTTTGCCCAATAATAAAGCCCCA
GAGAACTGGGCTGGGCCCTATGGGAAAAAAAAAAAAAAAAAAAAAAAAAAAAAAAAAAAAAG
```

FIGURE 188

```
MVPAWLWLLCVSVPQALPKAQPAELSVEVPENYGGNFPLYLTKLPLPREGAEGQIVLSGDSG
KATEGPFAMDPDSGFLLVTRALDREEQAEYQLQVTLEMQDGHVLWGPQPVLVHVKDENDQVP
HFSQAIYRARLSRGTRPGIPFLFLEASDRDEPGTANSDLRFHILSQAPAQPSPDMFQLEPRL
GALALSPKGSTSLDHALERTYQLLVQVKDMGDQASGHQATATVEVSIIESTWVSLEPIHLAE
NLKVLYPHHMAQVHWSGGDVHYHLESHPPGPFEVNAEGNLYVTRELDREAQAEYLLQVRAQN
SHGEDYAAPLELHVLVMDENDNVPICPPRDPTVSIPELSPPGTEVTRLSAEDADAPGSPNSH
VVYQLLSPEPEDGVEGRAFQVDPTSGSVTLGVLPLRAGQNILLLVLAMDLAGAEGGFSSTCE
VEVAVTDINDHAPEFITSQIGPISLPEDVEPGTLVAMLTAIDADLEPAFRLMDFAIERGDTE
GTFGLDWEPDSGHVRLRLCKNLSYEAAPSHEVVVVQSVAKLVGPGPGATATVTVLVERV
MPPPKLDQESYEASVPISAPAGSFLLTIQPSDPISRTLRFSLVNDSEGWLCIEKFSGEVHTA
QSLQGAQPGDTYTVLVEAQDTALTLAPVPSQYLCTPRQDHGLIVSGPSKDPDLASGHGPYSF
TLGPNPTVQRDWRLQTLNGSHAYLTLALHWVEPREHIIPVVVSHNAQMWQLLVRVIVCRCNV
EGQCMRKVGRMKGMPTKLSAVGILVGTLVAIGIFLILIFTHWTMSRKKDPDQPADSVPLKATV
```

Signal peptide:
amino acids 1-18

Transmembrane domain:
amino acids 762-784

FIGURE 189

```
GACTTTGCTTGAATGTTTACATTTTCTGCTCGCTGTCCTACATATCACAATATAGTGTTCACGTTTTGTTAAAA
CTTTGGGGTGTCAGGAGTTGAGCTTGCTCAGCAAGCCAGCATGGCTAGGATGAGCTTTGTTATAGCAGCTTGCC
AATTGGTGCTGGGCCTACTAATGACTTCATTAACCGAGTCTTCCATACAGAATAGTGAGTGTCCACAACTTTGC
GTATGTGAAATTCGTCCCTGGTTTACCCCACAGTCAACTTACAGAGAAGCCACCACTGTTGATTGCAATGACCT
CCGCTTAACAAGGATTCCCAGTAACCTCTCTAGTGACACACAAGTGCTTCTCTTACAGAGCAATAACATCGCGA
AGACTGTGGATGAGCTGCAGCAGCTTTTCAACTTGACTGAACTAGATTTCTCCCAAAACAACTTTACTAACATT
AAGGAGGTCGGGCTGGCAAACCTAACCCAGCTCACAACGCTGCATTTGGAGGAAAATCAGATTACCGAGATGAC
TGATTACTGTCTACAAGACCTCAGCAACCTTCAAGAACTCTACATCAACCACAACCAAATTAGCACTATTTCTG
CTCATGCTTTTGCAGGCTTAAAAAATCTATTAAGGCTCCACCTGAACTCCAACAAATTGAAAGTTATTGATAGT
CGCTGGTTTGATTCTACACCCAACCTGGAAATTCTCATGATCGGAGAAAACCCTGTGATTGGAATTCTGGATAT
GAACTTCAAACCCCTCGCAAATTTGAGAAGCTTAGTTTTGGCAGGAATGTATCTCACTGATATTCCTGGAAATG
CTTTGGTGGGTCTGGATAGCCTTGAGAGCCTGTCTTTTTATGATAACAAACTGGTTAAAGTCCCTCAACTTGCC
CTGCAAAAAGTTCCAAATTTGAAATTCTTAGACCTCAACAAAAACCCCATTCACAAAATCCAAGAAGGGGACTT
CAAAAATATGCTTCGGTTAAAAGAACTGGGAATCAACAATATGGGCGAGCTCGTTTCTGTCGACCGCTATGCCC
TGGATAACTTGCCTGAACTCACAAAGCTGGAAGCCACCAATAACCCTAAACTCTCTTACATCCACCGCTTGGCT
TTCCGAAGTGTCCCTGCTCTGGAAAGCTTGATGCTGAACAACAATGCCTTGAATGCCATTTACCAAAAGACAGT
CGAATCCCTCCCCAATCTGCGTGAGATCAGTATCCATAGCAATCCCCTCAGGTGTGACTGTGTGATCCACTGGA
TTAACTCCAACAAAACCAACATCCGCTTCATGGAGCCCCTGTCCATGTTCTGTGCCATGCCGCCCGAATATAAA
GGGCACCAGGTGAAGGAAGTTTTAATCCAGGATTCGAGTGAACAGTGCCTCCCAATGATATCTCACGACAGCTT
CCCAAATCGTTTAAACGTGGATATCGGCACGACGGTTTTCCTAGACTGTCGAGCCATGGCTGAGCCAGAACCTG
AAATTTACTGGGTCACTCCCATTGGAAATAAGATAACTGTGGAAACCCTTTCAGATAAATACAAGCTAAGTAGC
GAAGGTACCTTGGAAATATCTAACATACAAATTGAAGACTCAGGAAGATACACATGTGTTGCCCAGAATGTCCA
AGGGGCAGACACTCGGGTGGCAACAATTAAGGTTAACGGGACCCTTCTGGATGGTACCCAGGTGCTAAAAATAT
ACGTCAAGCAGACAGAATCCCATTCCATCTTAGTGTCCTGGAAAGTTAATTCCAATGTCATGACGTCAAACTTA
AAATGGTCGTCTGCCACCATGAAGATTGATAACCCTCACATAACATATACTGCCAGGGTCCCAGTCGATGTCCA
TGAATACAACCTAACGCATCTGCAGCCTTCCACAGATTATGAAGTGTGTCTCACAGTGTCCAATATTCATCAGC
AGACTCAAAAGTCATGCGTAAATGTCACAACCAAAAATGCCGCCTTCGCAGTGGACATCTCTGATCAAGAAACC
AGTACAGCCCTTGCTGCAGTAATGGGGTCTATGTTTGCCGTCATTAGCCTTGCGTCCATTGCTGTGTACTTTGC
CAAAAGATTTAAGAGAAAAAAACTACCACCACTCATTAAAAAAGTATATGCAAAAAACCTCTTCAATCCCACTAA
ATGAGCTGTACCCACCACTCATTAACCTCTGGGAAGGTGACAGCGAGAAAGACAAAGATGGTTCTGCAGACACC
AAGCCAACCCAGGTCGACACATCCAGAAGCTATTACATGTGGTAACTCAGAGGATATTTTGCTTCTGGTAGTAA
GGAGCACAAAGACGTTTTTGCTTTATTCTGCAAAAGTGAACAAGTTGAAGACTTTTGTATTTTGACTTTGCTA
GTTTGTGGCAGAGTGGAGAGGACGGGTGGATATTTCAAATTTTTTTAGTATAGCGTATCGCAAGGGTTTGACAC
GGCTGCCAGCGACTCTAGGCTTCCAGTCTGTGTTTGGTTTTTATTCTTATCATTATTATGATTGTTATTATATT
ATTATTTTATTTTAGTTGTTGTGCTAAACTCAATAATGCTGTTCTAACTACAGTGCTCAATAAATGATTAATG
ACAGGAAAAAAAAAAAAAAAAAAAAAAAAAAAAAAAAAAAAAAAAAAAAAAAAAAAAAAAAAAAAAAAAAAAA
AAAA
```

FIGURE 190

MARMSFVIAACQLVLGLLMTSLTESSIQNSECPQLCVCEIRPWFTPQSTYREATTVDCNDLRLTRIPSNLSSDT
QVLLLQSNNIAKTVDELQQLFNLTELDFSQNNFTNIKEVGLANLTQLTTLHLEENQITEMTDYCLQDLSNLQEL
YINHNQISTISAHAFAGLKNLLRLHLNSNKLKVIDSRWFDSTPNLEILMIGENPVIGILDMNFKPLANLRSLVL
AGMYLTDIPGNALVGLDSLESLSFYDNKLVKVPQLALQKVPNLKFLDLNKNPIHKIQEGDFKNMLRLKELGINN
MGELVSVDRYALDNLPELTKLEATNNPKLSYIHRLAFRSVPALESLMLNNNALNAIYQKTVESLPNLREISIHS
NPLRCDCVIHWINSNKTNIRFMEPLSMFCAMPPEYKGHQVKEVLIQDSSEQCLPMISHDSFPNRLNVDIGTTVF
LDCRAMAEPEPEIYWVTPIGNKITVETLSDKYKLSSEGTLEISNIQIEDSGRYTCVAQNVQGADTRVATIKVNG
TLLDGTQVLKIYVKQTESHSILVSWKVNSNVMTSNLKWSSATMKIDNPHITYTARVPVDVHEYNLTHLQPSTDY
EVCLTVSNIHQQTQKSCVNVTTKNAAFAVDISDQETSTALAAVMGSMFAVISLASIAVYFAKRFKRKNYHHSLK
KYMQKTSSIPLNELYPPLINLWEGDSEKDKDGSADTKPTQVDTSRSYYMW

Important features:
Signal peptide:

Amino acids 1-25

Transmembrane domain:

Amino acids 508-530

N-glycosylation sites:

Amino acids 69-73;96-100;106-110;117-121;385-389;517-521;
582-586;611-615

Tyrosine kinase phosphorylation site:

Amino acids 573-582

N-myristoylation sites:

Amino acids 16-22;224-230;464-470;637-643;698-704

FIGURE 191

```
GGGAGAGAGGATAAATAGCAGCGTGGCTTCCCTGGCTCCTCTCTGCATCCTTCCCGACCTTC
CCAGCAATATGCATCTTGCACGTCTGGTCGGCTCCTGCTCCCTCCTTCTGCTACTGGGGGCC
CTGTCTGGATGGGCGGCCAGCGATGACCCCATTGAGAAGGTCATTGAAGGGATCAACCGAGG
GCTGAGCAATGCAGAGAGAGAGGTGGGCAAGGCCCTGGATGGCATCAACAGTGGAATCACGC
ATGCCGGAAGGGAAGTGGAGAAGGTTTTCAACGGACTTAGCAACATGGGGAGCCACACCGGC
AAGGAGTTGGACAAAGGCGTCCAGGGGCTCAACCACGGCATGGACAAGGTTGCCCATGAGAT
CAACCATGGTATTGGACAAGCAGGAAAGGAAGCAGAGAAGCTTGGCCATGGGTCAACAACG
CTGCTGGACAGGCCGGGAAGGAAGCAGACAAAGCGGTCCAAGGGTTCCACACTGGGGTCCAC
CAGGCTGGGAAGGAAGCAGAGAAACTTGGCCAAGGGGTCAACCATGCTGCTGACCAGGCTGG
AAAGGAAGTGGAGAAGCTTGGCCAAGGTGCCCACCATGCTGCTGGCCAGGCCGGGAAGGAGC
TGCAGAATGCTCATAATGGGGTCAACCAAGCCAGCAAGGAGGCCAACCAGCTGCTGAATGGC
AACCATCAAAGCGGATCTTCCAGCCATCAAGGAGGGGCCACAACCACGCCGTTAGCCTCTGG
GGCCTCAGTCAACACGCCTTTCATCAACCTTCCCGCCCTGTGGAGGAGCGTCGCCAACATCA
TGCCCTAAACTGGCATCCGGCCTTGCTGGGAGAATAATGTCGCCGTTGTCACATCAGCTGAC
ATGACCTGGAGGGGTTGGGGGTGGGGACAGGTTTCTGAAATCCCTGAAGGGGTTGTACTG
GGATTTGTGAATAAACTTGATACACCA
```

FIGURE 192

```
></usr/seqdb2/sst/DNA/Dnaseqs.min/ss.DNA66675
><subunit 1 of 1, 247 aa, 1 stop
><MW: 25335, pI: 7.00, NX(S/T): 0
MHLARLVGSCSLLLLLGALSGWAASDDPIEKVIEGINRGLSNAEREVGKALDGINSGITHAG
REVEKVFNGLSNMGSHTGKELDKGVQGLNHGMDKVAHEINHGIGQAGKEAEKLGHGVNNAAG
QAGKEADKAVQGFHTGVHQAGKEAEKLGQGVNHAADQAGKEVEKLGQGAHHAAGQAGKELQN
AHNGVNQASKEANQLLNGNHQSGSSSHQGGATTTPLASGASVNTPFINLPALWRSVANIMP
```

Important features of the protein:
Signal peptide:
amino acids 1-25

Homologous region to circumsporozoite (CS) repeats:
amino acids 35-225

FIGURE 193

GAAGTAGAGGTGTTGTGCTGAGCGGCGCTCGGCGAACTGTGTGGACCGTCTGCTGGGACTCC
GGCCCTGCGTCCGCTCAGCCCCGTGGCCCCGCGCACCTACTGCCATGGAGACGCGGCCTCGT
CTCGGGGCCACCTGTTTGCTGGGCTTCAGTTTCCTGCTCCTCGTCATCTCTTCTGATGGACA
TAATGGGCTTGGAAAGGGTTTTGGAGATCATATTCATTGGAGGACACTGGAAGATGGGAAGA
AAGAAGCAGCTGCCAGTGGACTGCCCCTGATGGTGATTATTCATAAATCCTGGTGTGGAGCT
TGCAAAGCTCTAAAGCCCAAATTTGCAGAATCTACGGAAATTTCAGAACTCTCCCATAATTT
TGTTATGGTAAATCTTGAGGATGAAGAGGAACCCAAAGATGAAGATTTCAGCCCTGACGGGG
GTTATATTCCACGAATCCTTTTTCTGGATCCCAGTGGCAAGGTGCATCCTGAAATCATCAAT
GAGAATGGAAACCCCAGCTACAAGTATTTTTATGTCAGTGCCGAGCAAGTTGTTCAGGGGAT
GAAGGAAGCTCAGGAAAGGCTGACGGGTGATGCCTTCAGAAAGAAACATCTTGAAGATGAAT
TGTAACATGAATGTGCCCCTTCTTTCATCAGAGTTAGTGTTCTGGAAGGAAAGCAGCAGGGA
AGGGAATATTGAGGAATCATCTAGAACAATTAAGCCGACCAGGAAACCTCATTCCTACCTAC
ACTGGAAGGAGCGCTCTCACTGTGGAAGAGTTCTGCTAACAGAAGCTGGTCTGCATGTTTGT
GGATCCAGCGGAGAGTGGCAGACTTTCTTCTCCTTTTCCCTCTCACCTAAATGTCAACTTGT
CATTGAATGTAAAGAATGAAACCTTCTGACACAAAA

FIGURE 194

```
></usr/seqdb2/sst/DNA/Dnaseqs.min/ss.DNA67300
><subunit 1 of 1, 172 aa, 1 stop
><MW: 19206, pI: 5.36, NX(S/T): 1
METRPRLGATCLLGFSFLLLVISSDGHNGLGKGFGDHIHWRTLEDGKKEAAASGLPLMVI
IHKSWCGACKALKPKFAESTEISELSHNFVMVNLEDEEEPKDEDFSPDGGYIPRILFLDP
SGKVHPEIINENGNPSYKYFYVSAEQVVQGMKEAQERLTGDAFRKKHLEDEL
```

Important features of the protein:
Signal peptide:
Amino acids    1-23

Thioredoxin family proteins:
Amino acids    58-75

N-myristoylation sites:
Amino acids    29-35;67-73;150-156

Amidation site:
Amino acid    45-49

FIGURE 195

```
CGGCTCGAGTGCAGCTGTGGGGAGATTTCAGTGCATTGCCTCCCCTGGGTGCTCTTCATCTTGGATTTGAAAGT
TGAGAGCAGCATGTTTTGCCCACTGAAACTCATCCTGCTGCCAGTGTTACTGGATTATTCCTTGGGCCTGAATG
ACTTGAATGTTTCCCCGCCTGAGCTAACAGTCCATGTGGGTGATTCAGCTCTGATGGGATGTGTTTTCCAGAGC
ACAGAAGACAAATGTATATTCAAGATAGACTGGACTCTGTCACCAGGAGAGCACGCCAAGGACGAATATGTGCT
ATACTATTACTCCAATCTCAGTGTGCCTATTGGGCGCTTCCAGAACCGCGTACACTTGATGGGGGACATCTTAT
GCAATGATGGCTCTCTCCTGCTCCAAGATGTGCAAGAGGCTGACCAGGGAACCTATATCTGTGAAATCCGCCTC
AAAGGGGAGAGCCAGGTGTTCAAGAAGGCGGTGGTACTGCATGTGCTTCCAGAGGAGCCCAAAGAGCTCATGGT
CCATGTGGGTGGATTGATTCAGATGGGATGTGTTTTCCAGAGCACAGAAGTGAAACACGTGACCAAGGTAGAAT
GGATATTTTCAGGACGGCGCGCAAAGGAGGAGATTGTATTTCGTTACTACCACAAACTCAGGATGTCTGTGGAG
TACTCCCAGAGCTGGGGCCACTTCCAGAATCGTGTGAACCTGGTGGGGGACATTTTCCGCAATGACGGTTCCAT
CATGCTTCAAGGAGTGAGGGAGTCAGATGGAGGAAACTACACCTGCAGTATCCACCTAGGGAACCTGGTGTTCA
AGAAAACCATTGTGCTGCATGTCAGCCCGGAAGAGCCTCGAACACTGGTGACCCCGGCAGCCCTGAGGCCTCTG
GTCTTGGGTGGTAATCAGTTGGTGATCATTGTGGGAATTGTCTGTGCCACAATCCTGCTGCTCCCTGTTCTGAT
ATTGATCGTGAAGAAGACCTGTGGAAATAAGAGTTCAGTGAATTCTACAGTCTTGGTGAAGAACACGAAGAAGA
CTAATCCAGAGATAAAAGAAAAACCCTGCCATTTTGAAAGATGTGAAGGGGAGAAACATTTACTCCCCAATA
ATTGTACGGGAGGTGATCGAGGAAGAAGAACCAAGTGAAAAATCAGAGGCCACCTACATGACCATGCACCCAGT
TTGGCCTTCTCTGAGGTCAGATCGGAACAACTCACTTGAAAAAAAGTCAGGTGGGGAATGCCAAAAACACAGC
AAGCCTTTTGAGAAGAATGGAGAGTCCCTTCATCTCAGCAGCGGTGGAGACTCTCTCCTGTGTGTGTCCTGGGC
CACTCTACCAGTGATTTCAGACTCCCGCTCTCCCAGCTGTCCTCCTGTCTCATTGTTTGGTCAATACACTGAAG
ATGGAGAATTTGGAGCCTGGCAGAGAGACTGGACAGCTCTGGAGGAACAGGCCTGCTGAGGGGAGGGGAGCATG
GACTTGGCCTCTGCAGTGGGACACTGGCCCTGGGAACCAGGCTGAGCTGAGTGGCCTCAAACCCCCGTTGGAT
CAGACCCTCCTGTGGGCAGGGTTCTTAGTGGATGAGTTACTGGGAAGAATCAGAGATAAAAACCAACCCAAATCAA
```

FIGURE 196

MFCPLKLILLPVLLDYSLGLNDLNVSPPELTVHVGDSALMGCVFQSTEDKCIFKIDWTLSPGEHAKDEYVLYYY
SNLSVPIGRFQNRVHLMGDILCNDGSLLLQDVQEADQGTYICEIRLKGESQVFKKAVVLHVLPEEPKELMVHVG
GLIQMGCVFQSTEVKHVTKVEWIFSGRRAKEEIVFRYYHKLRMSVEYSQSWGHFQNRVNLVGDIFRNDGSIMLQ
GVRESDGGNYTCSIHLGNLVFKKTIVLHVSPEEPRTLVTPAALRPLVLGGNQLVIIVGIVCATILLLPVLILIV
KKTCGNKSSVNSTVLVKNTKKTNPEIKEKPCHFERCEGEKHIYSPIIVREVIEEEEPSEKSEATYMTMHPVWPS
LRSDRNNSLEKKSGGGMPKTQQAF

FIGURE 197

CGCCATGGCCGGGCTATCCCGCGGGTCCGCGCGCGCACTGCTCGCCGCCCTGCTGGCGTCGACG
CTGTTGGCGCTGCTCGTGTCGCCCGCGCGGGGTCGCGGCGGCCGGGACCACGGGGACTGGGA
CGAGGCCTCCCGGCTGCCGCCGCTACCACCCCGCGAGGACGCGGCGCGCGTGGCCCGCTTCG
TGACGCACGTCTCCGACTGGGGCGCTCTGGCCACCATCTCCACGCTGGAGGCGGTGCGCGGC
CGGCCCTTCGCCGACGTCCTCTCGCTCAGCGACGGGCCCCGGGCGCGGGCAGCGGCGTGCC
CTATTTCTACCTGAGCCCGCTGCAGCTCTCCGTGAGCAACCTGCAGGAGAATCCATATGCTA
CACTGACCATGACTTTGGCACAGACCAACTTCTGCAAGAAACATGGATTTGATCCACAAAGT
CCCCTTTGTGTTCACATAATGCTGTCAGGAACTGTGACCAAGGTGAATGAAACAGAAATGGA
TATTGCAAAGCATTCGTTATTCATTCGACACCCTGAGATGAAAACCTGGCCTTCCAGCCATA
ATTGGTTCTTTGCTAAGTTGAATATAACCAATATCTGGGTCCTGGACTACTTTGGTGGACCA
AAAATCGTGACACCAGAAGAATATTATAATGTCACAGTTCAGTGAAGCAGACTGTGGTGAAT
TTAGCAACACTTATGAAGTTTCTTAAAGTGGCTCATACACACTTAAAAGGCTTAATGTTTCT
CTGGAAAGCGTCCCAGAATATTAGCCAGTTTTCTGTC

FIGURE 198

```
></usr/seqdb2/sst/DNA/Dnaseqs.min/ss.DNA71269
><subunit 1 of 1, 220 aa, 1 stop
><MW: 24075, pI: 7.67, NX(S/T): 3
MAGLSRGSARALLAALLASTLLALLVSPARGRGGRDHGDWDEASRLPPLPPREDAARVAR
FVTHVSDWGALATISTLEAVRGRPFADVLSLSDGPPGAGSGVPYFYLSPLQLSVSNLQEN
PYATLTMTLAQTNFCKKHGFDPQSPLCVHIMLSGTVTKVNETEMDIAKHSLFIRHPEMKT
WPSSHNWFFAKLNITNIWVLDYFGGPKIVTPEEYYNVTVQ
```

Important features of the protein:
Transmembrane domain:
Amino acids
11-29

N-glycosylation sites:
Amino acids
160-164;193-197;216-220

N-myristoylation sites:
Amino acids
3-9;7-13;69-75;97-103

FIGURE 199

```
TCGCCATGGCCTCTGCCGGAATGCAGATCCTGGGAGTCGTCCTGACACTGCTGGGCTGGGTG
AATGGCCTGGTCTCCTGTGCCCTGCCCATGTGGAAGGTGACCGCTTTCATCGGCAACAGCAT
CGTGGTGGCCCAGGTGGTGTGGGAGGGCCTGTGGATGTCCTGCGTGGTGCAGAGCACCGGCC
AGATGCAGTGCAAGGTGTACGACTCACTGCTGGCGCTGCCACAGGACCTGCAGGCTGCACGT
GCCCTCTGTGTCATCGCCCTCCTTGTGGCCCTGTTCGGCTTGCTGGTCTACCTTGCTGGGGC
CAAGTGTACCACCTGTGTGGAGGAGAAGGATTCCAAGGCCCGCCTGGTGCTCACCTCTGGGA
TTGTCTTTGTCATCTCAGGGGTCCTGACGCTAATCCCCGTGTGCTGGACGGCGCATGCCATC
ATCCGGGACTTCTATAACCCCCTGGTGGCTGAGGCCCAAAAGCGGGAGCTGGGGGCCTCCCT
CTACTTGGGCTGGGCGGCCTCAGGCCTTTTGTTGCTGGGTGGGGGGTTGCTGTGCTGCACTT
GCCCCTCGGGGGGGTCCCAGGGCCCCAGCCATTACATGGCCCGCTACTCAACATCTGCCCCT
GCCATCTCTCGGGGGCCCTCTGAGTACCCTACCAAGAATTACGTCTGACGTGGAGGGGAATG
GGGGCTCCGCTGGCGCTAGAGCCATCCAGAAGTGGCAGTGCCCAACAGCTTTGGGATGGGTT
CGTACCTTTTGTTTCTGCCTCCTGCTATTTTTCTTTTGACTGAGGATATTTAAAATTCATTT
GAAAACTGAGCCAAGGTGTTGACTCAGACTCTCACTTAGGCTCTGCTGTTTCTCACCCTTGG
ATGATGGAGCCAAAGAGGGGATGCTTTGAGATTCTGGATCTTGACATGCCCATCTTAGAAGC
CAGTCAAGCTATGGAACTAATGCGGAGGCTGCTTGCTGTGCTGGCTTTGCAACAAGACAGAC
TGTCCCCAAGAGTTCCTGCTGCTGCTGGGGGCTGGGCTTCCCTAGATGTCACTGGACAGCTG
CCCCCCATCCTACTCAGGTCTCTGGAGCTCCTCTCTTCACCCCTGGAAAAACAAATCATCTG
TTAACAAAGGACTGCCCACCTCCGGAACTTCTGACCTCTGTTTCCTCCGTCCTGATAAGACG
TCCACCCCCAGGGCCAGGTCCCAGCTATGTAGACCCCGCCCCACCTCCAACACTGCACC
CTTCTGCCCTGCCCCCTCGTCTCACCCCCTTTACACTCACATTTTTATCAAATAAAGCATG
TTTTGTTAGTGCA
```

FIGURE 200

></usr/seqdb2/sst/DNA/Dnaseqs.min/ss.DNA73736
><subunit 1 of 1, 220 aa, 1 stop
><MW: 23292, pI: 8.43, NX(S/T): 0
MASAGMQILGVVLTLLGWVNGLVSCALPMWKVTAFIGNSIVVAQVVWEGLWMSCVVQSTGQM
QCKVYDSLLALPQDLQAARALCVIALLVALFGLLVYLAGAKCTTCVEEKDSKARLVLTSGIV
FVISGVLTLIPVCWTAHAIIRDFYNPLVAEAQKRELGASLYLGWAASGLLLLGGGLLCCTCP
SGGSQGPSHYMARYSTSAPAISRGPSEYPTKNYV

Transmembrane domains:
amino acids 8-30 (type II), 82-102, 121-140, 166-186

FIGURE 201

AGTGACAATCTCAGAGCAGCTTCTACACCACAGCCATTTCCAGCATGAAGATCACTGGGGGTCTCCTTCTGCTC
TGTACAGTGGTCTATTTCTGTAGCAGCTCAGAAGCTGCTAGTCTGTCTCCAAAAAAAGTGGACTGCAGCATTTA
CAAGAAGTATCCAGTGGTGGCCATCCCCTGCCCCATCACATACCTACCAGTTTGTGGTTCTGACTACATCACCT
ATGGGAATGAATGTCACTTGTGTACCGAGAGCTTGAAAAGTAATGGAAGAGTTCAGTTTCTTCACGATGGAAGT
TGCTAAATTCTCCATGGACATAGAGAGAAAGGAATGATATTCTCATCATCATCTTCATCATCCCAGGCTCTGAC
TGAGTTTCTTTCAGTTTTACTGATGTTCTGGGTGGGGACAGAGCCAGATTCAGAGTAATCTTGACTGAATGGA
GAAAGTTTCTGTGCTACCCCTACAAACCCATGCCTCACTGACAGACCAGCATTTTTTTTTTAACACGTCAATAA
AAAAATAATCTCCCAGA

FIGURE 202

MKITGGLLLLCTVVYFCSSSEAASLSPKKVDCSIYKKYPVVAIPCPITYLPVCGSDYITYGNECHLCTESLKSN
GRVQFLHDGSC

Important features:
Signal peptide:
amino acids 1-19

FIGURE 203

```
CGACGATGCTACGCGCGCCCGGCTGCCTCCTCCGGACCTCCGTAGCGCCTGCCGCGGCCCTGGCTGCGGCGCTG
CTCTCGTCGCTTGCGCGCTGCTCTCTTCTAGAGCCGAGGGACCCGGTGGCCTCGTCGCTCAGCCCCTATTTCGG
CACCAAGACTCGCTACGAGGATGTCAACCCCGTGCTATTGTCGGGCCCCGAGGCTCCGTGGCGGGACCCTGAGC
TGCTGGAGGGGACCTGCACCCCGGTGCAGCTGGTCGCCCTCATTCGCCACGGCACCCGCTACCCCACGGTCAAA
CAGATCCGCAAGCTGAGGCAGCTGCACGGGTTGCTGCAGGCCCGCGGGTCCAGGGATGGCGGGGCTAGTAGTAC
CGGCAGCCGCGACCTGGGTGCAGCGCTGGCCGACTGGCCTTTGTGGTACGCGGACTGGATGGACGGGCAGCTAG
TAGAGAAGGGACGGCAGGATATGCGACAGCTGGCGCTGCGTCTGGCCTCGCTCTTCCCGGCCCTTTTCAGCCGT
GAGAACTACGGCCGCCTGCGGCTCATCACCAGTTCCAAGCACCGCTGCATGGATAGCAGCGCCGCCTTCCTGCA
GGGGCTGTGGCAGCACTACCACCCTGGCTTGCCGCCGCCGGACGTCGCAGATATGGAGTTTGGACCTCCAACAG
TTAATGATAAACTAATGAGATTTTTTGATCACTGTGAGAAGTTTTTAACTGAAGTAGAAAAAAATGCTACAGCT
CTTTATCACGTGGAAGCCTTCAAAACTGGACCAGAAATGCAGAACATTTTAAAAAAAGTTGCAGCTACTTTGCA
AGTGCCAGTAAATGATTTAAATGCAGATTTAATTCAAGTAGCCTTTTTCACCTGTTCATTTGACCTGGCAATTA
AAGGTGTTAAATCTCCTTGGTGTGATGTTTTTGACATAGATGATGCAAAGGTATTAGAATATTTAAATGATCTG
AAACAATATTGGAAAGAGGATATGGGTATACTATTAACAGTCGATCCAGCTGCACCTTGTTTCAGGATATCTT
TCAGCACTTGGACAAAGCAGTTGAACAGAAACAAAGGTCTCAGCCAATTTCTTCTCCAGTCATCCTCCAGTTTG
GTCATGCAGAGACTCTTCTTCCACTGCTTTCTCTCATGGGCTACTTCAAAGACAAGCAACCCCTAACAGCGTAC
AATTACAAAAAACAAATGCATCGGAAGTTCCGAAGTGGTCTCATTGTACCTTATGCCTCGAACCTGATATTTGT
GCTTTACCACTGTGAAAATGCTAAGCACTCCTAAAGAACAATTCCGAGTGCAGATGTTATTAAATGAAAAGGTGT
TACCTTTGGCTTACTCACAAGAAACTGTTTCATTTTATGAAGATCTGAAGAACCACTACAAGGACATCCTTCAG
AGTTGTCAAACCAGTGAAGAATGTGAATTAGCAAGGGCTAACAGTACATCTGATGAACTATGAGTAACTGAAGA
ACATTTTTAATTCTTTAGGAATCTGCAATGAGTGATTACATGCTTGTAATAGGTAGGCAATTCCTTGATTACAG
GAAGCTTTTATATTACTTGAGTATTTCTGTCTTTTCACAGAAAACATTGGGTTTCTCTCTGGGTTTGGACATG
AAATGTAAGAAAAGATTTTTCACTGGAGCAGCTCTCTTAAGGAGAAACAAATCTATTTAGAGAAACAGCTGGCC
CTGCAAATGTTTACAGAAATGAAATTCTTCCTACTTATATAAGAAATCTCACACTGAGATAGAATTGTGATTTC
ATAATAACACTTGAAAAGTGCTGGAGTAACAAAATATCTCAGTTGGACCATCCTTAACTTGATTGAACTGTCTA
GGAACTTTACAGATTGTTCTGCAGTTCTCTCTTCTTTTCCTCAGGTAGGACAGCTCTAGCATTTTCTTAATCAG
GAATATTGTGGTAAGCTGGGAGTATCACTCTGGAAGAAAGTAACATCTCCAGATGAGAATTTGAAACAAGAAAC
AGAGTGTTGTAAAAGGACACCTTCACTGAAGCAAGTCGGAAAGTACAATGAAAATAAATATTTTTGGTATTTAT
TTATGAAATATTTGAACATTTTTTCAATAATTCCTTTTTACTTCTAGGAAGTCTCAAAAGACCATCTTAAATTA
TTATATGTTTGGACAATTAGCAACAAGTCAGATAGTTAGAATCGAAGTTTTTCAAATCCATTGCTTAGCTAACT
TTTTCATTCTGTCACTTGGCTTCGATTTTTATATTTTCCTATTATATGAAATGTATCTTTTGGTTGTTTGATTT
TTCTTTCTTTCTTTGTAAATAGTTCTGAGTTCTGTCAAATGCCGTGAAAGTATTTGCTATAATAAAGAAATTC
TTGTGACTTTAAAAAAAAA
```

FIGURE 204

MLRAPGCLLRTSVAPAAALAAALLSSLARCSLLEPRDPVASSLSPYFGTKTRYEDVNPVLLSGPEAPWRDPELL
EGTCTPVQLVALIRHGTRYPTVKQIRKLRQLHGLLQARGSRDGGASSTGSRDLGAALADWPLWYADWMDGQLVE
KGRQDMRQLALRLASLFPALFSRENYGRLRLITSSKHRCMDSSAAFLQGLWQHYHPGLPPPDVADMEFGPPTVN
DKLMRFFDHCEKFLTEVEKNATALYHVEAFKTGPEMQNILKKVAATLQVPVNDLNADLIQVAFFTCSFDLAIKG
VKSPWCDVFDIDDAKVLEYLNDLKQYWKRGYGYTINSRSSCTLFQDIFQHLDKAVEQKQRSQPISSPVILQFGH
AETLLPLLSLMGYFKDKEPLTAYNYKKQMHRKFRSGLIVPYASNLIFVLYHCENAKTPKEQFRVQMLLNEKVLP
LAYSQETVSFYEDLKNHYKDILQSCQTSEECELARANSTSDEL

Important features:
Signal sequence
amino acids 1-30

N-glycosylation sites.
amino acids 242-246, 481-485

N-myristoylation sites.
amino acids 107-113, 113-119, 117-123, 118-124, 128-134

Endoplasmic reticulum targeting sequence.
amino acids 484-489

FIGURE 205

```
GCGACGCGCGGCGGGGCGGCGAGAGGAAACGCGGCGCCGGGCCGGGCCCGGCCCTGGAGATG
GTCCCCGGCGCCGCGGGCTGGTGTTGTCTCGTGCTCTGGCTCCCCGCGTGCGTCGCGGCCCA
CGGCTTCCGTATCCATGATTATTTGTACTTTCAAGTGCTGAGTCCTGGGGACATTCGATACA
TCTTCACAGCCACACCTGCCAAGGACTTTGGTGGTATCTTTCACACAAGGTATGAGCAGATT
CACCTTGTCCCCGCTGAACCTCCAGAGGCCTGCGGGGAACTCAGCAACGGTTTCTTCATCCA
GGACCAGATTGCTCTGGTGGAGAGGGGGGGCTGCTCCTTCCTCTCCAAGACTCGGGTGGTCC
AGGAGCACGGCGGGCGGGCGGTGATCATCTCTGACAACGCAGTTGACAATGACAGCTTCTAC
GTGCAGATGATCCAGGACAGTACCCAGCGCACAGCTGACATCCCCGCCCTCTTCCTGCTCGG
CCGAGACGGCTACATGATCCGCCGCTCTCTGGAACAGCATGGGCTGCCATGGGCCATCATTT
CCATCCCAGTCAATGTCACCAGCATCCCCACCTTTGAGCTGCTGCAACCGCCCTGGACCTTC
TGGTAGAAGAGTTTGTCCCACATTCCAGCCATAAGTGACTCTGAGCTGGGAAGGGGAAACCC
AGGAATTTTGCTACTTGGAATTTGGAGATAGCATCTGGGGACAAGTGGAGCCAGGTAGAGGA
AAAGGGTTTGGGCGTTGCTAGGCTGAAAGGGAAGCCACACCACTGGCCTTCCCTTCCCCAGG
GCCCCCAAGGGTGTCTCATGCTACAAGAAGAGGCAAGAGACAGGCCCCAGGGCTTCTGGCTA
GAACCCGAAACAAAAGGAGCTGAAGGCAGGTGGCCTGAGAGCCATCTGTGACCTGTCACACT
CACCTGGCTCCAGCCTCCCCTACCCAGGGTCTCTGCACAGTGACCTTCACAGCAGTTGTTGG
AGTGGTTTAAAGAGCTGGTGTTTGGGGACTCAATAAACCCTCACTGACTTTTTAGCAATAAA
GCTTCTCATCAGGGTTGCAAAAAAAAAAAAAAAAAAAAAAAAAA
```

FIGURE 206

></usr/seqdb2/sst/DNA/Dnaseqs.min/ss.DNA76532
><subunit 1 of 1, 188 aa, 1 stop
><MW: 21042, pI: 5.36, NX(S/T): 2
MVPGAAGWCCLVLWLPACVAAHGFRIHDYLYFQVLSPGDIRYIFTATPAKDFGGIFHTRYEQ
IHLVPAEPPEACGELSNGFFIQDQIALVERGGCSFLSKTRVVQEHGGRAVIISDNAVDNDSF
YVEMIQDSTQRTADIPALFLLGRDGYMIRRSLEQHGLPWAIISIPVNVTSIPTFELLQPPWTFW

Signal peptide:
amino acids 1-20

FIGURE 207

```
CTCGCTTCTTCCTTCTGGATGGGGGCCCAGGGGGCCCAGGAGAGTATAAAGGCGATGTGGAG
GGTGCCCGGCACAACCAGACGCCCAGTCACAGGCGAGAGCCCTGGGATGCACCGGCCAGAGG
CCATGCTGCTGCTGCTCACGCTTGCCCTCCTGGGGGGCCCCACCTGGGCAGGGAAGATGTAT
GGCCCTGGAGGAGGCAAGTATTTCAGCACCACTGAAGACTACGACCATGAAATCACAGGCT
GCGGGTGTCTGTAGGTCTTCTCCTGGTGAAAAGTGTCCAGGTGAAACTTGGAGACTCCTGGG
ACGTGAAACTGGGAGCCTTAGGTGGGAATACCCAGGAAGTCACCCTGCAGCCAGGCGAATAC
ATCACAAAAGTCTTTGTCGCCTTCCAAGCTTTCCTCCGGGGTATGGTCATGTACACCAGCAA
GGACCGCTATTTCTATTTTGGGAAGCTTGATGGCCAGATCTCCTCTGCCTACCCCAGCCAAG
AGGGGCAGGTGCTGGTGGGCATCTATGGCCAGTATCAACTCCTTGGCATCAAGAGCATTGGC
TTTGAATGGAATTATCCACTAGAGGAGCCGACCACTGAGCCACCAGTTAATCTCACATACTC
AGCAAACTCACCCGTGGGTCGCTAGGGTGGGGTATGGGGCCATCCGAGCTGAGGCCATCTGT
GTGGTGGTGGCTGATGGTACTGGAGTAACTGAGTCGGGACGCTGAATCTGAATCCACCAATA
AATAAAGCTTCTGCAGAAAA
```

FIGURE 208

></usr/seqdb2/sst/DNA/Dnaseqs.min/ss.DNA76541
><subunit 1 of 1, 178 aa, 1 stop
><MW: 19600, pI: 5.89, NX(S/T): 1
MHRPEAMLLLLTLALLGGPTWAGKMYGPGGGKYFSTTEDYDHEITGLRVSVGLLLVKSVQVK
LGDSWDVKLGALGGNTQEVTLQPGEYITKVFVAFQAFLRGMVMYTSKDRYFYFGKLDGQISS
AYPSQEGQVLVGIYGQYQLLGIKSIGFEWNYPLEEPTTEPPVNLTYSANSPVGR

Signal peptide:
amino acids 1-22

FIGURE 209

```
GGAGAATGGAGAGAGCAGTGAGAGTGGAGTCCGGGGTCCTGGTCGGGGTGGTCTGTCTGCTCCTGGCATGCCCT
GCCACAGCCACTGGGCCCGAAGTTGCTCAGCCTGAAGTAGACACCACCCTGGGTCGTGTGCGAGGCCGGCAGGT
GGGCGTGAAGGGCACAGACCGCCTTGTGAATGTCTTTCTGGGCATTCCATTTGCCCAGCCGCCACTGGGCCCTG
ACCGGTTCTCAGCCCCCACACCCAGCACAGCCCTGGGAGGGTGTGCGGGATGCCAGCACTGCGCCCCCAATGTGC
CTACAAGACGTGGAGAGCATGAACAGCAGCAGATTTGTCCTCAACGGAAAACAGCAGATCTTCTCCGTTTCAGA
GGACTGCCTGGTCCTCAACGTCTATAGCCCAGCTGAGGTCCCCGCAGGGTCCGGTAGGCCGGTCATGGTATGGG
TCCATGGAGGCGCTCTGATAACTGGCGCTGCCACCTCCTACGATGGATCAGCTCTGGCTGCCTATGGGGATGTG
GTCGTGGTTACAGTCCAGTACCGCCTTGGGGTCCTTGGCTTCTTCAGCACTGGAGATGAGCATGCACCTGGCAA
CCAGGGCTTCCTAGATGTGGTAGCTGCTTTGCGCTGGGTGCAAGAAAACATCGCCCCCTTCGGGGGTGACCTCA
ACTGTGTCACTGTCTTTGGTGGATCTGCCGGTGGGAGCATCATCTCTGGCCTGGTCCTGTCCCAGTGGCTGCA
GGGCTGTTCCACAGAGCCATCACACAGAGTGGGGTCATCACCACCCCAGGGATCATCGACTCTCACCCTTGGCC
CCTAGCTCAGAAAATCGCAAACACCTTGGCCTGCAGCTCCAGCTCCCCGGCTGAGATGGTGCAGTGCCTTCAGC
AGAAAGAAGGAGAAGAGCTGGTCCTTAGCAAGAAGCTGAAAAATACTATCTATCCTCTCACCGTTGATGGCACT
GTCTTCCCCAAAAGCCCCAAGGAACTCCTGAAGGAGAAGCCCTTCCACTCTGTGCCCTTCCTCATGGGCTGTCAA
CAACCATGAGTTCAGCTGGCTCATCCCCAGGGGCTGGGGTCTCCTGGATACAATGGAGCAGATGAGCCGGGAGG
ACATGCTGGCCATCTCAACACCCGTCTTGACCAGTCTGGATGTGCCCCCTGAGATGATGCCCACCGTCATAGAT
GAATACCTAGGAAGCAACTCGGACGCACAAGCCAAATGCCAGGCGTTCCAGGAATTCATGGGTGACGTATTCAT
CAATGTTCCCACCGTCAGTTTTTTCAAGATACCTTCGAGATTCTGGAAGCCCTGTCTTTTTCTATGAGTTCCAGC
ATCGACCCAGTTCTTTTGCGAAGATCAAACCTGCCTGGGTGAAGGCTGATCATGGGGCCGAGGGTGCTTTTGTG
TTCGGAGGTCCCTTCCTCATGGACGAGAGCTCCCGCCTGGCCTTTCCAGAGGCCACAGAGGAGGAGAAGCAGCT
AAGCCTCACCATGATGGCCCAGTGGACCCACTTTGCCCGGACAGGGGACCCCAATAGCAAGGCTCTGCCTCCTT
GGCCCCAATTCAACCAGGCGGAACAATATCTGGAGATCAACCCAGTGCCACGGGCCGGACAGAAGTTCAGGGAG
GCCTGGATGCAGTTCTGGTCAGAGACGCTCCCCAGCAAGATACAACAGTGGCACCAGAAGCAGAAGAACAGGAA
GGCCCAGGAGGACCTCTGAGGCCAGGCCTGAACCTTCTTGGCTGGGGCAAACCACTCTTCAAGTGGTGGCAGAG
TCCCAGCACGGCAGCCCGCCTCTCCCCCTGCTGAGACTTTAATCTCCACCAGCCCTTAAAGTGTCGGCCGCTCT
GTGACTGGAGTTATGCTCTTTTTGAAATGTCACAAGGCCGCCTCCCACCTCTGGGGCATTGTACAAGTTCTTCCC
TCTCCCTGAAGTGCCCTTTCCTGCTTTCTTCGTGGTAGGTTCTAGCACATTCCTCTAGCTTCCTGCAGGACTCAC
TCCCCAGGAAGCCTTCCCTGCCTTCTCTGGGCTGTGCGGCCCCGAGTCTGCGTCCATTAGAGCACAGTCCACCC
GAGGCTAGCACCGTGTCTGTGTCTGTCTCCCCCTCAGAGGAGCTCTCTCAAAATGGGGATTAGCCTAACCCCAC
TCTGTCACCCACACCAGGATCGGGTGGGACCTGGAGCTAGCGGGTGTTTGCTGAGTGAGTGAGTGAAACACAGA
ATATGGGAATGGCAGCTGCTGAACTTGAACCCAGAGCCTTCAGGTGCCAAAGCCATACTCAGGCCCCCACCGAC
ATTGTCCACCCTGGCCAGAAGGGTGCATGCCAATGGCAGAGACCTGGGATGGGAGAAGTCCTGGGGCGCCAGGG
GATCCAGCCTAGAGCAGACCTTAGCCCCTGACTAAGGCCTCAGACTAGGGCGGGAGGGGTCTCCTCCTCTCTGC
TGCCCAGTCCTGGCCCCTGCACAAGACAACAGAATCCATCAGGGCCATGAGTGTCACCCAGACCTGACCCTCAC
CAATTCCAGCCCCTGACCCTCAGGACGCTGGATGCCAGCTCCCAGCCCCAGTGCCGGGTCCTCCCTCCCTTCCT
GGCTTGGGGAGACCAGTTTCTGGGGAGCTTCCAAGAGCACCCACCAAGACACAGCAGGACAGGCCAGGGGAGGG
CATCTGGACCAGGGCATCCGTCGGGCTATTGTCACAGAGAAAGAAGAGACCCACCCACTCGGGCTGCAAAAGG
TGAAAAGCACCAAGAGGTTTTCAGATGGAAGTGAGAGGTGACAGTGTGCTGGCAGCCCTCACAGCCCTCGCTTG
CTCTCCCTGCCGCCTCTGCCTGGGCTCCCACTTTGGCAGCACTTGAGGAGCCCTTCAACCCGCCGCTGCACTGT
AGGAGCCCCTTTCTGGGCTGGCCAAGGCCGGAGCCAGCTCCCTCAGCTTGCGGGGAGGTGCGGAGGGAGAGGGG
CGGGCAGGAACCGGGCTGCGCGCAGCGCTTGCGGGCCAGAGTGAGTTCCGGGTGGGCGTGGGCTCGGCGGGGC
CCCACTCAGAGCAGCTGGCCGGCCCCAGGCAGTGAGGGCCTTAGCACCTGGGCCAGCAGCTGCTGTGCTCGATT
TCTCGCTGGGCCTTAGCTGCCTCCCCGCGGGCCAGGGCTCGGGACCTGCAGCCCTCCATGCCTGACCCTCCCCC
CACCCCCGTGGGCTCCTGTGCGGCCGGAGCCTCCCCAAGGAGCGCCGCCCCTGCTCCACAGCGCCCAGTCCC
ATCGACCACCCAAGGGCTGAGGAGTGCGGGTGCACAGCGCGGGACTCGCAGGCAGCTCCACCTGCTGCCCCAGT
GCTGGATCCACTGGGTGAAGCCAGCTGGGCTCCTGAGTCTGGTGGGGACTTGGAGAACCTTTATGTCTAGCTAA
GGGATTGTAAATACACCGATGGGCACTCTGTATCTAGCTCAAGGTTTGTAAACACACCAATCAGCACCCTGTGT
CTAGCTCAGTGTTTGTGAATGCACCAATCCACACTCTGTATCTGGCTACTCTGGTGGGGACTTGGAGAACCTTT
GTGTCCACACTCTGTATCTAGCTAATCTAGTGGGGATGTGGAGAACCTTTGTGTCTAGCTCAGGGATCGTAAAC
GCACCAATCAGCACCCTGTCAAAACAGACCACTTGACTCTCTGTAAAATGGACCAATCAGCAGGATGTGGGTGG
GGCCAGACAAGAGAATAAAAGCAGGCTGCCTGAGCCAGCAGTGACAACCCCCCTCGGGTCCCCTCCCACGCCGT
GGAAGCTTTGTTCTTTCGCTCTTTGCAATAAATCTTGCTACTGCCCAAAA
```

FIGURE 210

MERAVRVESGVLVGVVCLLLACPATATGPEVAQPEVDTTLGRVRGRQVGVKGTDRLVNVFLGIPFAQPPLGPDR
FSAPHPAQPWEGVRDASTAPPMCLQDVESMNSSRFVLNGKQQIFSVSEDCLVLNVYSPAEVPAGSGRPVMVWVH
GGALITGAATSYDGSALAAYGDVVVVTVQYRLGVLGFFSTGDEHAPGNQGFLDVVAALRWVQENIAPFGGDLNC
VTVFGGSAGGSIISGLVLSPVAAGLFHRAITQSGVITTPGIIDSHPWPLAQKIANTLACSSSSPAEMVQCLQQK
EGEELVLSKKLKNTIYPLTVDGTVFPKSPKELLKEKPFHSVPFLMGVNNHEFSWLIPRGWGLLDTMEQMSREDM
LAISTPVLTSLDVPPEMMPTVIDEYLGSNSDAQAKCQAFQEFMGDVFINVPTVSFSRYLRDSGSPVFFYEFQHR
PSSFAKIKPAWVKADHGAEGAFVFGGPFLMDESSRLAFPEATEEEKQLSLTMMAQWTHFARTGDPNSKALPPWP
QFNQAEQYLEINPVPRAGQKFREAWMQFWSETLPSKIQQWHQKQKNRKAQEDL

Important features:
Signal peptide:
amino acids 1-27

Transmembrane domain:
amino acids 226-245

N-glycosylation site.
amino acids 105-109

N-myristoylation sites.
amino acids 10-16, 49-55, 62-68, 86-92, 150-156, 155-161, 162-168, 217-223, 227-233, 228-234, 232-238, 262-268, 357-363, 461-467

Prokaryotic membrane lipoprotein lipid attachment site.
amino acids 12-23

Carboxylesterases type-B serine active site.
amino acids 216-232

FIGURE 211

AACTTCTACATGGGCCTCCTGCTGCTGGTGCTCTTCCTCAGCCTCCTGCCGGTGGCCTACAC
CATCATGTCCCTCCCACCCTCCTTTGACTGCGGGCCGTTCAGGTGCAGAGTCTCAGTTGCCC
GGGAGCACCTCCCCTCCCGAGGCAGTCTGCTCAGAGGGCCTCGGCCCAGAATTCCAGTTCTG
GTTTCATGCCAGCCTGTAAAAGGCCATGGAACTTTGGGTGAATCACCGATGCCATTTAAGAG
GGTTTTCTGCCAGGATGGAAATGTTAGGTCGTTCTGTGTCTGCGCTGTTCATTTCAGTAGCC
ACCAGCCACCTGTGGCCGTTGAGTGCTTGAAATGAGGAACTGAGAAAATTAATTTCTCATGT
ATTTTTCTCATTTATTTATTAATTTTTAACTGATAGTTGTACATATTTGGGGTACATGTGA
TATTTGGATACATGTATACAATATATAATGATCAAATCAGGGTAACTGGGATATCCATCACA
TCAAACATTTATTTTTTATTCTTTTTAGACAGAGTCTCACTCTGTCACCCAGGCTGGAGTGC
AGTGGTGCCATCTCAGCTTACTGCAACCTCTGCCTGCCAGGTTCAAGCGATTCTCATGCCTC
CACCTCCCAAGTAGCTGGGACTACAGGCATGCACCACAATGCCCAACTAATTTTGTATTTT
TAGTAGAGACGGGGTTTTGCCATGTTGCCCAGGCTGGCCTTGAACTCCTGGCCTCAAACAAT
CCACTTGCCTCGGCCTCCCAAAGTGTTATGATTACAGGCGTGAGCCACCGTGCCTGGCCTAA
ACATTTATCTTTTCTTTGTGTTGGGAACTTTGAAATTATACAATGAATTATTGTTAACTGTC
ATCTCCCTGCTGTGCTATGGAACACTGGGACTTCTTCCCTCTATCTAACTGTATATTTGTAC
CAGTTAACCAACCGTACTTCATCCCCACTCCTCTCTATCCTTCCCAACCTCTGATCACCTCA
TTCTACTCTCTACCTCCATGAGATCCACTTTTTTAGCTCCCACATGTGAGTAAGAAAATGCA
ATATTTGTCTTTCTGTGCCTGGCTTATTTCACTTAACATAATGACTTCCTGTTCCATCCATG
TTGCTGCAAATGACAGGATTTCGTTCTTAATTTCAATTAAAATAACCACACATGGCAAAAA

FIGURE 212

MGLLLLVLFLSLLPVAYTIMSLPPSFDCGPFRCRVSVAREHLPSRGSLLRGPRPRIPVLVSC
QPVKGHGTLGESPMPFKRVFCQDGNVRSFCVCAVHFSSHQPPVAVECLK

Important features of the protein:
Signal peptide:
amino acids 1-18

N-myristoylation site.
amino acids 86-92

Zinc carboxypeptidases, zinc-binding region 2 signature.
amino acids 68-79

FIGURE 213

```
AGGGCCCGCGGGTGGAGAGAGCGACGCCCGAGGGGATGGCGGCAGCGTCCCGGAGCGCCTCT
GGCTGGGCGCTACTGCTGCTGGTGGCACTTTGGCAGCAGCGCGCGGCCGGCTCCGGCGTCTT
CCAGCTGCAGCTGCAGGAGTTCATCAACGAGCGCGGCGTACTGGCCAGTGGGCGGCCTTGCG
AGCCCGGCTGCCGGACTTTCTTCCGCGTCTGCCTTAAGCACTTCCAGGCGGTCGTCTCGCCC
GGACCCTGCACCTTCGGGACCGTCTCCACGCCGGTATTGGGCACCAACTCCTTCGCTGTCCG
GGACGACAGTAGCGGCGGGGGGCGCAACCCTCTCCAACTGCCCTTCAATTTCACCTGGCCGG
GTACCTTCTCGCTCATCATCGAAGCTTGGCACGCGCCAGGAGACGACCTGCGGCCAGAGGCC
TTGCCACCAGATGCACTCATCAGCAAGATCGCCATCCAGGGCTCCCTAGCTGTGGGTCAGAA
CTGGTTATTGGATGAGCAAACCAGCACCCTCACAAGGCTGCGCTACTCTTACCGGGTCATCT
GCAGTGACAACTACTATGGAGACAACTGCTCCCGCCTGTGCAAGAAGCGCAATGACCACTTC
GGCCACTATGTGTGCCAGCCAGATGGCAACTTGTCCTGCCTGCCCGGTTGGACTGGGGAATA
TTGCCAACAGCCTATCTGTCTTTCGGGCTGTCATGAACAGAATGGCTACTGCAGCAAGCCAG
CAGAGTGCCTCTGCCGCCCAGGCTGGCAGGGCCGGCTGTGTAACGAATGCATCCCCCACAAT
GGCTGTCGCCACGGCACCTGCAGCACTCCCTGGCAATGTACTTGTGATGAGGGCTGGGGAGG
CCTGTTTTGTGACCAAGATCTCAACTACTGCACCCACCACTCCCCATGCAAGAATGGGGCAA
CGTGCTCCAACAGTGGGCAGCGAAGCTACACCTGCACCTGTCGCCCAGGCTACACTGGTGTG
GACTGTGAGCTGGAGCTCAGCGAGTGTGACAGCAACCCCTGTCGCAATGGAGGCAGCTGTAA
GGACCAGGAGGATGGCTACCACTGCCTGTGTCCTCCGGGCTACTATGGCCTGCACTGTGAAC
ACAGCACCTTGAGCTGCGCCGACTCCCCCTGCTTCAATGGGGGCTCCTGCCGGGAGCGCAAC
CAGGGGGCCAACTATGCTTGTGAATGTCCCCCAACTTCACCGGCTCCAACTGCGAGAAGAA
AGTGGACAGGTGCACCAGCAACCCCTGTGCCAACGGGGACAGTGCCTGAACCGAGGTCCAA
GCCGCATGTGCCGCTGCCGTCCTGGATTCACGGGCACCTACTGTGAACTCCACGTCAGCGAC
TGTGCCCGTAACCCTTGCGCCCACGGTGGCACTTGCCATGACCTGGAGAATGGGCTCATGTG
CACCTGCCCTGCCGGCTTCTCTGGCCGACGCTGTGAGGTGCGGACATCCATCGATGCCTGTG
CCTCGAGTCCCTGCTTCAACAGGGCCACCTGCTACACCGACCTCTCCACAGACACCTTTGTG
TGCAACTGCCCTTATGGCTTTGTGGGCAGCCGCTGCGAGTTCCCCGTGGGCTTGCCGCCCAG
CTTCCCCTGGGTGGCCGTCTCGCTGGGTGTGGGGCTGGCAGTGCTGCTGGTACTGCTGGGCA
TGGTGGCAGTGGCTGTGCGGCAGCTGCGGCTTCGACGGCCGGACGACGGCAGCAGGGAAGCC
ATGAACAACTTGTCGGACTTCCAGAAGGACAACCTGATTCCTGCCGCCCAGCTTAAAAACAC
AAACCAGAAGAAGGAGCTGGAAGTGGACTGTGGCCTGGACAAGTCCAACTGTGGCAAACAGC
AAAACCACACATTGGACTATAATCTGGCCCCAGGGCCCTGGGGCGGGGGACCATGCCAGGA
AAGTTTCCCCACAGTGACAAGAGCTTAGGAGAGAAGGCGCCACTGCGGTTACACAGTGAAAA
GCCAGAGTGTCGGATATCAGCGATATGCTCCCCAGGGACTCCATGTACCAGTCTGTGTGTT
TGATATCAGAGGAGAGGAATGAATGTGTCATTGCCACGGAGGTATAAGGCAGGAGCCTACCT
GGACATCCCTGCTCAGCCCCGCGGCTGGACCTTCCTTCTGCATTGTTTACA
```

FIGURE 214

MAAASRSASGWALLLLVALWQQRAAGSGVFQLQLQEFINERGVLASGRPCEPGCRTFFRVCL
KHFQAVVSPGPCTFGTVSTPVLGTNSFAVRDDSSGGGRNPLQLPFNFTWPGTFSLIIEAWHA
PGDDLRPEALPPDALISKIAIQGSLAVGQNWLLDEQTSTLTRLRYSYRVICSDNYYGDNCSR
LCKKRNDHFGHYVCQPDGNLSCLPGWTGEYCQQPICLSGCHEQNGYCSKPAECLCRPGWQGR
LCNECIPHNGCRHGTCSTPWQCTCDEGWGGLFCDQDLNYCTHHSPCKNGATCSNSGQRSYTC
TCRPGYTGVDCELELSECDSNPCRNGGSCKDQEDGYHCLCPPGYYGLHCEHSTLSCADSPCF
NGGSCRERNQGANYACECPPNFTGSNCEKKVDRCTSNPCANGGQCLNRGPSRMCRCRPGFTG
TYCELHVSDCARNPCAHGGTCHDLENGLMCTCPAGFSGRRCEVRTSIDACASSPCFNRATCY
TDLSTDTFVCNCPYGFVGSRCEFPVGLPPSFPWVAVSLGVGLAVLLVLLGMVAVAVRQLRLR
RPDDGSREAMNNLSDFQKDNLIPAAQLKNTNQKKELEVDCGLDKSNCGKQQNHTLDYNLAPG
PLGRGTMPGKFPHSDKSLGEKAPLRLHSEKPECRISAICSPRDSMYQSVCLISEERNECVIA
TEV

Important features of the protein:
Signal peptide:
amino acids 1-26
Transmembrane domain:
amino acids 530-552
N-glycosylation sites.
amino acids 108-112, 183-187, 205-209, 393-397, 570-574, 610-614
Glycosaminoglycan attachment site.
amino acids 96-100
Tyrosine kinase phosphorylation site.
amino acids 340-347
N-myristoylation sites.
amino acids 42-48, 204-210, 258-264, 277-283, 297-303, 383-389, 415-421, 461-467, 522-528, 535-541, 563-569, 599-605, 625-631
Amidation site.
amino acids 471-475
Aspartic acid and asparagine hydroxylation site.
amino acids 339-351
EGF-like domain cysteine pattern signature.
amino acids 173-185, 206-218, 239-251, 270-282, 310-322, 348-360, 388-400, 426-438, 464-476, 506-518
Calcium-binding EGF-like:
amino acids 224-245, 255-276, 295-316, 333-354, 373-394, 411-432, 449-470

FIGURE 215

```
CGCGAGGCGCGGGGAGCCTGGGACCAGGAGCGAGAGCCGCCTACCTGCAGCCGCCGCCCACG
GCACGGCAGCCACCATGGCGCTCCTGCTGTGCTTCGTGCTCCTGTGCGGAGTAGTGGATTTC
GCCAGAAGTTTGAGTATCACTACTCCTGAAGAGATGATTGAAAAAGCCAAAGGGGAAACTGC
CTATCTGCCATGCAAATTTACGCTTAGTCCCGAAGACCAGGGACCGCTGGACATCGAGTGGC
TGATATCACCAGCTGATAATCAGAAGGTGGATCAAGTGATTATTTTATATTCTGGAGACAAA
ATTTATGATGACTACTATCCAGATCTGAAAGGCCGAGTACATTTTACGAGTAATGATCTCAA
ATCTGGTGATGCATCAATAAATGTAACGAATTTACAACTGTCAGATATTGGCACATATCAGT
GCAAAGTGAAAAAAGCTCCTGGTGTTGCAAATAAGAAGATTCATCTGGTAGTTCTTGTTAAG
CCTTCAGGTGCGAGATGTTACGTTGATGGATCTGAAGAAATTGGAAGTGACTTTAAGATAAA
ATGTGAACCAAAAGAAGGTTCACTTCCATTACAGTATGAGTGGCAAAAATTGTCTGACTCAC
AGAAAATGCCCACTTCATGGTTAGCAGAAATGACTTCATCTGTTATATCTGTAAAAAATGCC
TCTTCTGAGTACTCTGGGACATACAGCTGTACAGTCAGAAACAGAGTGGGCTCTGATCAGTG
CCTGTTGCGTCTAAACGTTGTCCCTCCTTCAAATAAAGCTGGACTAATTGCAGGAGCCATTA
TAGGAACTTTGCTTGCTCTAGCGCTCATTGGTCTTATCATCTTTTGCTGTCGTAAAAAGCGC
AGAGAAGAAAAATATGAAAAGGAAGTTCATCACGATATCAGGGAAGATGTGCCACCTCCAAA
GAGCCGTACGTCCACTGCCAGAAGCTACATCGGCAGTAATCATTCATCCCTGGGGTCCATGT
CTCCTTCCAACATGGAAGGATATTCCAAGACTCAGTATAACCAAGTACCAAGTGAAGACTTT
GAACGCACTCCTCAGAGTCCGACTCTCCCACCTGCTAAGTTCAAGTACCCTTACAAGACTGA
TGGAATTACAGTTGTATAAATATGGACTACTGAAGAATCTGAAGTATTGTATTATTTGACTT
TATTTTAGGCCTCTAGTAAAGACTTAAATGTTTTTTAAAAAAAGCACAAGGCACAGAGATTA
GAGCAGCTGTAAGAACACATCTACTTTATGCAATGGCATTAGACATGTAAGTCAGATGTCAT
GTCAAAATTAGTACGAGCCAAATTCTTTGTTAAAAAACCCTATGTATAGTGACACTGATAGT
TAAAAGATGTTTTATTATATTTTCAATAACTACCACTAACAAATTTTTAACTTTTCATATGC
ATATTCTGATATGTGGTCTTTTAGGAAAAGTATGGTTAATAGTTGATTTTCAAAGGAAATT
TTAAAATTCTTACGTTCTGTTTAATGTTTTTGCTATTTAGTTAAATACATTGAAGGGAAATA
CCCGTTCTTTTCCCCTTTTATGCACACAACAGAAACACGCGTTGTCATGCCTCAAACTATTT
TTTATTTGCAACTACATGATTTCACACAATTCTCTTAAACAACGACATAAAATAGATTTCCT
TGTATATAAATAACTTACATACGCTCCATAAAGTAAATTCTCAAAGGTGCTAGAACAAATCG
TCCACTTCTACAGTGTTCTCGTATCCAACAGAGTTGATGCACAATATATAAATACTCAAGTC
CAATATTAAAAACTTAGGCACTTGACTAACTTTAATAAAATTTCTCAAACTATATCAATATC
TAAAGTGCATATATTTTTAAGAAAGATTATTCTCAATAACTTCTATAAAAATAAGTTTGAT
GGTTTGGCCCATCTAACTTCACTACTATTAGTAAGAACTTTTAACTTTTAATGTGTAGTAAG
GTTTATTCTACCTTTTTCTCAACATGACACCAACACAATCAAAAACGAAGTTAGTGAGGTGC
TAACATGTGAGGATTAATCCAGTGATTCCGGTCACAATGCATTCCAGGAGGAGGTACCCATG
TCACTGGAATTGGGCGATATGGTTTATTTTTTCTTCCCTGATTTGGATAACCAAATGGAACA
GGAGGAGGATAGTGATTCTGATGGCCATTCCCTCGATACATTCCTGGCTTTTTCTGGGCAA
AGGGTGCCACATTGGAAGAGGTGGAAATATAAGTTCTGAAATCTGTAGGGAAGAGAACACAT
TAAGTTAATTCAAAGGAAAAATCATCATCTATGTTCCAGATTTCTCATTAAAGACAAAGTT
ACCCACAACACTGAGATCACATCTAAGTGACACTCCTATTGTCAGGTCTAAATACATTAAAA
ACCTCATGTGTAATAGGCGTATAATGTATAACAGGTGACCAATGTTTCTGAATGCATAAAG
AAATGAATAAACTCAAACACAGTACTTCCTAAACAACTTCAACCAAAAAGACCAAAACATG
GAACGAATGGAAGCTTGTAAGGACATGCTTGTTTAGTCCAGTGGTTTCCACAGCTGGCTAA
GCCAGGAGTCACTTGGAGGCTTTTAAATACAAACATTGGAGCTGGAGGCCATTATCCTTAG
CAAACTAATGCAGAAACAGAAATCAACTACCGCATGTTCTCACTTATAAGTGGGAGGTAAT
GATAAGAACTTATGAACACAAAGAAGGAAACAATAGACATTGGAGTCTATTTGAGAGGGGAG
GGTGGGAGAAGGAAAAGGAGCAGAAAAGATAACTATTGAGTACTGCCTTCACACCTGGGTGA
TGAAATAATATGTACAACAAATCCCTGTGACACATGTTTACCTATGGAACAAACCTTCATGT
GTATCCCTAAACCTAAAATAAAGTTAAAAAAAAAAAAARAAAAAAAAAAAAAAAAAAAAAA
AAAAAAAAAAAAAAAAAAAAAAAAAAAAAAAAAAAAAAAAAAAAAAAAAAAAAAAAAAAAA
AAAAAAAAAAAAAAAAAAAA
```

FIGURE 216

></usr/seqdb2/sst/DNA/Dnaseqs.full/ss.DNA82361
><subunit 1 of 1, 352 aa, 1 stop
><MW: 38938, pI: 7.86, NX(S/T): 3
MALLLCFVLLCGVVDFARSLSITTPEEMIEKAKGETAYLPCKFTLSPEDQGPLDIEWLISPA
DNQKVDQVIILYSGDKIYDDYYPDLKGRVHFTSNDLKSGDASINVTNLQLSDIGTYQCKVKK
APGVANKKIHLVVLVKPSGARCYVDGSEEIGSDFKIKCEPKEGSLPLQYEWQKLSDSQKMPT
SWLAEMTSSVISVKNASSEYSGTYSCTVRNRVGSDQCLLRLNVVPPSNKAGLIAGAIIGTLL
ALALIGLIIFCCRKKRREEKYEKEVHHDIREDVPPPKSRTSTARSYIGSNHSSLGSMSPSNM
EGYSKTQYNQVPSEDFERTPQSPTLPPAKFKYPYKTDGITVV

Signal sequence.
amino acids 1-19

Transmembrane domain:
amino acids 236-257

N-glycosylation sites.
amino acids 106-110, 201-205, 298-302

Tyrosine kinase phosphorylation sites.
amino acids 31-39, 78-85, 262-270

N-myristoylation sites.
amino acids 116-122, 208-214, 219-225, 237-243, 241-247, 245-251, 296-302

Myelin P0 protein.
amino acids 96-125

FIGURE 217

```
GATGGCGCAGCCACAGCTTCTGTGAGATTCGATTTCTCCCCAGTTCCCCTGTGGGTCTGAGG
GGACCAGAAGGGTGAGCTACGTTGGCTTTCTGGAAGGGGAGGCTATATGCGTCAATTCCCCA
AAACAAGTTTTGACATTTCCCCTGAAATGTCATTCTCTATCTATTCACTGCAAGTGCCTGCT
GTTCCAGGCCTTACCTGCTGGGCACTAACGGCGGAGCCAGGATGGGGACAGAATAAAGGAGC
CACGACCTGTGCCACCAACTCGCACTCAGACTCTGAACTCAGACCTGAAATCTTCTCTTCAC
GGGAGGCTTGGCAGTTTTTCTTACTCCTGTGGTCTCCAGATTTCAGGCCTAAGATGAAAGCC
TCTAGTCTTGCCTTCAGCCTTCTCTCTGCTGCGTTTTATCTCCTATGGACTCCTTCCACTGG
ACTGAAGACACTCAATTTGGGAAGCTGTGTGATCGCCACAAACCTTCAGGAAATACGAAATG
GATTTTCTGAGATACGGGGCAGTGTGCAAGCCAAAGATGGAAACATTGACATCAGAATCTTA
AGGAGGACTGAGTCTTTGCAAGACACAAAGCCTGCGAATCGATGCTGCCTCCTGCGCCATTT
GCTAAGACTCTATCTGGACAGGGTATTTAAAAACTACCAGACCCCTGACCATTATACTCTCC
GGAAGATCAGCAGCCTCGCCAATTCCTTTCTTACCATCAAGAAGGACCTCCGGCTCTCTCAT
GCCCACATGACATGCCATTGTGGGGAGGAAGCAATGAAGAAATACAGCCAGATTCTGAGTCA
CTTTGAAAAGCTGGAACCTCAGGCAGCAGTTGTGAAGGCTTTGGGGGAACTAGACATTCTTC
TGCAATGGATGGAGGAGACAGAATAGGAGGAAAGTGATGCTGCTGCTAAGAATATTCGAGGT
CAAGAGCTCCAGTCTTCAATACCTGCAGAGGAGGCATGACCCCAAACCACCATCTCTTTACT
GTACTAGTCTTGTGCTGGTCACAGTGTATCTTATTTATGCATTACTTGCTTCCTTGCATGAT
TGTCTTTATGCATCCCCAATCTTAATTGAGACCATACTTGTATAAGATTTTTGTAATATCTT
TCTGCTATTGGATATATTTATTAGTTAATATATTTATTTATTTTTTGCTATTTAATGTATTT
ATTTTTTTACTTGGACATGAAACTTTAAAAAAATTCACAGATTATATTTATAACCTGACTAG
AGCAGGTGATGTATTTTTATACAGTAAAAAAAAAAAACCTTGTAAATTCTAGAAGAGTGGCT
AGGGGGGTTATTCATTTGTATTCAACTAAGGACATATTTACTCATGCTGATGCTCTGTGAGA
TATTTGAAATTGAACCAATGACTACTTAGGATGGGTTGTGGAATAAGTTTTGATGTGGAATT
GCACATCTACCTTACAATTACTGACCATCCCCAGTAGACTCCCCAGTCCCATAATTGTGTAT
CTTCCAGCCAGGAATCCTACACGGCCAGCATGTATTTCTACAAATAAAGTTTTCTTTGCATA
CCAAAAAAAAAAAAAAAAAAA
```

FIGURE 218

></usr/seqdb2/sst/DNA/Dnaseqs.min/ss.DNA83500

MKASSLAFSLLSAAFYLLWTPSTGLKTLNLGSCVIATNLQEIRNGFSEIRGSVQAKDGN
IDIRILRRTESLQDTKPANRCCLLRHLLRLYLDRVFKNYQTPDHYTLRKISSLANSFLT
IKKDLRLSHAHMTCHCGEEAMKKYSQILSHFEKLEPQAAVVKALGELDILLQWMEETE

FIGURE 219

```
CGCGGAGCCCTGCGCTGGGAGGTGCACGGTGTGCACGCTGGACTGGACCCCCATGCAACCCC
GCGCCCTGCGCCTTAACCAGGACTGCTCCGCGCGCCCCTGAGCCTCGGGCTCCGGCCCGGAC
CTGCAGCCTCCCAGGTGGCTGGGAAGAACTCTCCAACAATAAATACATTTGATAAGAAAGAT
GGCTTTAAAAGTGCTACTAGAACAAGAGAAAACGTTTTTCACTCTTTTAGTATTACTAGGCT
ATTTGTCATGTAAAGTGACTTGTGAATCAGGAGACTGTAGACAGCAAGAATTCAGGGATCGG
TCTGGAAACTGTGTTCCCTGCAACCAGTGTGGGCCAGGCATGGAGTTGTCTAAGGAATGTGG
CTTCGGCTATGGGGAGGATGCACAGTGTGTGACGTGCCGGCTGCACAGGTTCAAGGAGGACT
GGGGCTTCCAGAAATGCAAGCCCTGTCTGGACTGCGCAGTGGTGAACCGCTTTCAGAAGGCA
AATTGTTCAGCCACCAGTGATGCCATCTGCGGGGACTGCTTGCCAGGATTTTATAGGAAGAC
GAAACTTGTCGGCTTTCAAGACATGGAGTGTGTGCCTTGTGGAGACCCTCCTCCTCCTTACG
AACCGCACTGTGCCAGCAAGGTCAACCTCGTGAAGATCGCGTCCACGGCCTCCAGCCCACGG
GACACGGCGCTGGCTGCCGTTATCTGCAGCGCTCTGGCCACCGTCCTGCTGGCCCTGCTCAT
CCTCTGTGTCATCTATTGTAAGAGACAGTTTATGGAGAAGAAACCCAGCTGGTCTCTGCGGT
CGCAGGACATTCAGTACAACGGCTCTGAGCTGTCGTGTTTTGACAGACCTCAGCTCCACGAA
TATGCCCACAGAGCCTGCTGCCAGTGCCGCCGTGACTCAGTGCAGACCTGCGGGCCGGTGCG
CTTGCTCCCATCCATGTGCTGTGAGGAGGCCTGCAGCCCCAACCCGGCGACTCTTGGTTGTG
GGGTGCATTCTGCAGCCAGTCTTCAGGCAAGAAACGCAGGCCCAGCCGGGGAGATGGTGCCG
ACTTTCTTCGGATCCCTCACGCAGTCCATCTGTGGCGAGTTTTCAGATGCCTGGCCTCTGAT
GCAGAATCCCATGGGTGGTGACAACATCTCTTTTTGTGACTCTTATCCTGAACTCACTGGAG
AAGACATTCATTCTCTCAATCCAGAACTTGAAAGCTCAACGTCTTTGGATTCAAATAGCAGT
CAAGATTTGGTTGGTGGGCTGTTCCAGTCCAGTCTCATTCTGAAAACTTTACAGCAGCTAC
TGATTTATCTAGATATAACAACACACTGGTAGAATCAGCATCAACTCAGGATGCACTAACTA
TGAAGCCAGCTAGATCAGGAGAGTGGCGCTGTCATCCACCCAGCCACTCAGACGTCCCTC
CAGGAAGCTTAAAGAACCTGCTTCTTTCTGCAGTAGAAGCGTGTGCTGGAACCCAAAGAGTA
CTCCTTTGTTAGGCTTATGGACTGAGCAGTCTGGACCTTGCATGGCTTCTGGGGCAAAAATA
AATCTGAACCAAACTGACGGCATTTGAAGCCTTTCAGCCAGTTGCTTCTGAGCCAGACCAGC
TGTAAGCTGAAACCTCAATGAATAACAAGAAAAGACTCCAGGCCGACTCATGATACTCTGCA
TCTTTCCTACATGAGAAGCTTCTCTGCCACAAAAGTGACTTCAAAGACTGATGGGTTGAGCT
GGCAGCCTATGAGATTGTGGACATATAACAAGAAACAGAAATGCCCTCATGCTTATTTTCAT
GGTGATTGTGGTTTTACAAGACTGAAGACCCAGAGTATACTTTTTCTTTCCAGAAATAATTT
CATACCGCCTATGAAATATCAGATAAATTACCTTAGCTTTTATGTAGAATGGGTTCAAAAGT
GAGTGTTTCTATTTGAGAAGGACACTTTTTCATCATCTAAACTGATTCGCATAGGTGGTTAG
AATGGCCCTCATATTGCCTGCCTAAATCTTGGGTTTATTAGATGAAGTTTACTGAATCAGAG
GAATCAGACAGAGGAGGATAGCTCTTTCCAGAATCCACACTTCTGACCTCAGCCTCGGTCTC
ATGAACACCCGCTGATCTCAGGAGAACACCTGGGCTAGGGAATGTGGTCGAGAAAGGGCAGC
CCATTGCCCAGAATTAACACATATTGTAGAGACTTGTATCCAAAGGTTGGCATATTTATATG
AAAATTAGTTGCTATAGAAACATTTGTTGCATCTGTCCCTCTGCCTGAGCTTAGAAGGTTAT
AGAAAAGGGTATTTATAAACATAAATGACCTTTTACTTGCATTGTATCTTATACTAAAGGC
TTTAGAAATTACAACATATCAGGTTCCCCTACTACTGAAGTAGCCTTCCGTGAGAACACACC
ACATGTTAGGACTAGAAGAAAATGCACAATTTGTAGGGGTTTGGATGAAGCAGCTGTAACTG
CCCTAGTGTAGTTTGACCAGGACATTGTCGTGCTCCTTCCAATTGTGTAAGATTAGTTAGCA
CATCATCTCCTACTTTAGCCATCCGGTGTTGGATTTAAGAGGACGGTGCTTCTTTCTATTAA
AGTGCTCCATCCCCTACCATCTACACATTAGCATTGTCTAGAGCTAAGACAGAAATTAAC
CCCGTTCAGTCACAAAGCAGGGAATGGTTCATTTACTCTTAATCTTTATGCCCTGGAGAAGA
CCTACTTGAACAGGGCATATTTTTTAGACTTCTGAACATCAGTATGTTCGAGGGTACTATGA
TATTTTGGTTTGGAATTGCCCTGCCCAAGTCACTGTCTTTTAACTTTTAAACTGAATATTAA
AATGTATCTGTCTTTCCT
```

FIGURE 220

```
></usr/seqdb2/sst/DNA/Dnaseqs.min/ss.DNA84210
><subunit 1 of 1, 417 aa, 1 stop
><MW: 45305, pI: 5.12, NX(S/T): 6
MALKVLLEQEKTFFTLLVLLGYLSCKVTCESGDCRQQEFRDRSGNCVPCNQCGPGMELSK
ECGFGYGEDAQCVTCRLHRFKEDWGFQKCKPCLDCAVVNRFQKANCSATSDAICGDCLPG
FYRKTKLVGFQDMECVPCGDPPPPYEPHCASKVNLVKIASTASSPRDTALAAVICSALAT
VLLALLILCVIYCKRQFMEKKPSWSLRSQDIQYNGSELSCFDRPQLHEYAHRACCQCRRD
SVQTCGPVRLLPSMCCEEACSPNPATLGCGVHSAASLQARNAGPAGEMVPTFFGSLTQSI
CGEFSDAWPLMQNPMGGDNISFCDSYPELTGEDIHSLNPELESSTSLDSNSSQDLVGGAV
PVQSHSENFTAATDLSRYNNTLVESASTQDALTMRSQLDQESGAVIHPATQTSLQEA
```

Important features of the protein:
Signal peptide:
Amino acids
1-25

Transmembrane domain:
Amino acids
169-192

N-glycosylation sites:
Amino acids
105-109;214-218;319-323;350-354;368-372;379-383 cAMP- and cGMP-dependent protein kinase phosphorylation sites:
Amino acids
200-204;238-242

Tyrosine kinase phosphorylation site:
Amino acids
207-214

N-myristoylation sites:
Amino acids
55-61;215-221;270-276

Prokaryotic membrane lipoprotein lipid attachment site:
Amino acids
259-270

TNFR/NGFR family cysteine-rich region proteins:
Amino acids
89-96

FIGURE 221

```
CTAGAGAGTATAGGGCAGAAGGATGGCAGATGAGTGACTCCACATCCAGAGCTGCCTCCCTT
TAATCCAGGATCCTGTCCTTCCTGTCCTGTAGGAGTGCCTGTTGCCAGTGTGGGGTGAGACA
AGTTTGTCCCACAGGGCTGTCTGAGCAGATAAGATTAAGGGCTGGGTCTGTGCTCAATTAAC
TCCTGTGGGCACGGGGGCTGGGAAGAGCAAAGTCAGCGGTGCCTACAGTCAGCACCATGCTG
GGCCTGCCGTGGAAGGGAGGTCTGTCCTGGGCGCTGCTGCTGCTTCTCTTAGGCTCCCAGAT
CCTGCTGATCTATGCCTGGCATTTCCACGAGCAAAGGGACTGTGATGAACACAATGTCATGG
CTCGTTACCTCCCTGCCACAGTGGAGTTTGCTGTCCACACATTCAACCAACAGAGCAAGGAC
TACTATGCCTACAGACTGGGGCACATCTTGAATTCCTGGAAGGAGCAGGTGGAGTCCAAGAC
TGTATTCTCAATGGAGCTACTGCTGGGAGAACTAGGTGTGGGAAATTTGAAGACGACATTG
ACAACTGCCATTTCCAAGAAAGCACAGAGCTGAACAATACTTTCACCTGCTTCTTCACCATC
AGCACCAGGCCCTGGATGACTCAGTTCAGCCTCCTGAACAAGACCTGCTTGGAGGGATTCCA
CTGAGTGAAACCCACTCACAGGCTTGTCCATGTGCTGCTCCCACATTCCGTGGACATCAGCA
CTACTCTCCTGAGGACTCTTCAGTGGCTGAGCAGCTTTGGACTTGTTTGTTATCCTATTTTG
CATGTGTTTGAGATCTCAGATCAGTGTTTTAGAAAATCCACACATCTTGAGCCTAATCATGT
AGTGTAGATCATTAAACATCAGCATTTTAAGAAAAAAAAAAAAAAAAAAAAAAAAAAAAAAA
AAAAAAAAAAAAAAAAAAAAAAAAAAAAAA
```

FIGURE 222

MLGLPWKGGLSWALLLLLLGSQILLIYAWHFHEQRDCDEHNVMARYLPATVEFAVHTFNQQS
KDYYAYRLGHILNSWKEQVESKTVFSMELLLGRTRCGKFEDDIDNCHFQESTELNNTFTCFF
TISTRPWMTQFSLLNKTCLEGFH

Important features of the protein:
Signal peptide:
amino acids 1-25

N-glycosylation sites.
amino acids 117-121, 139-143

N-myristoylation site.
amino acids 9-15

FIGURE 223

AATCGGCTGATTCTGCATCTGGAAACTGCCTTCATCTTGAAAGAAAAGCTCCAGGTCCCT
TCTCCAGCCACCCAGCCCCAAGATGGTGATGCTGCTGCTGCTGCTTTCCGCACTGGCTGG
CCTCTTCGGTGCGGCAGAGGGACAAGCATTTCATCTTGGGAAGTGCCCCAATCCTCCGGT
GCAGGAGAATTTTGACGTGAATAAGTATCTCGGAAGATGGTACGAAATTGAGAAGATCCC
AACAACCTTTGAGAATGGACGCTGCATCCAGGCCAACTACTCACTAATGGAAAACGGAAA
GATCAAAGTGTTAAACCAGGAGTTGAGAGCTGATGGAACTGTGAATCAAATCGAAGGTGA
AGCCACCCCAGTTAACCTCACAGAGCCTGCCAAGCTGGAAGTTAAGTTTTCCTGGTTTAT
GCCATCGGCACCGTACTGGATCCTGGCCACCGACTATGAGAACTATGCCCTCGTGTATTC
CTGTACCTGCATCATCCAACTTTTTCACGTGGATTTTGCTTGGATCTTGGCAAGAAACCC
TAATCTCCCTCCAGAAACAGTGGACTCTCTAAAAAATATCCTGACTTCTAATAACATTGA
TGTCAAGAAAATGACGGTCACAGACCAGGTGAACTGCCCCAAGCTCTCGTAACCAGGTTC
TACAGGGAGGCTGCACCCACTCCATGTTACTTCTGCTTCGCTTTCCCCTACCCCACCCCC
CCCCCATAAAGACAAACCAATCAACCACGACAAAGGAAGTTGACCTGAACATGTAACCAT
GCCCTACCCTGTTACCTTGCTAGCTGCAAAATAAACTTGTTGCTGACCTGCTGTGCTCGC
AAAAAA

FIGURE 224

MVMLLLLLSALAGLFGAAEGQAFHLGKCPNPPVQENFDVNKYLGRWYEIEKIPTTFENG
RCIQANYSLMENGKIKVLNQELRADGTVNQIEGEATPVNLTEPAKLEVKFSWFMPSAPY
WILATDYENYALVYSCTCIIQLFHVDFAWILARNPNLPPETVDSLKNILTSNNIDVKKM
TVTDQVNCPKLS

Signal sequence
1-16

N-glycosylation site.

65-68
98-101 cAMP- and cGMP-dependent protein kinase phosphorylation site.

175-178

N-myristoylation site.

13-18
16-21

Lipocalin proteins.

36-47
120-130

Lipocalin / cytosolic fatty-acid binding proteins 41-185

FIGURE 225

GGGTGATTGAACTAAACCTTCGCCGCACCGAGTTTGCAGTACGGCCGTCACCCGCACCGCTG
CCTGCTTGCGGTTGGAGAAATCAAGGCCCTACCGGGCCTCCGTAGTCACCTCTCTATAGTGG
GCGTGGCCGAGGCCGGGGTGACCCTGCCGGAGCCTCCGCTGCCAGCGACATGTTCAAGGTAA
TTCAGAGGTCCGTGGGGCCAGCCAGCCTGAGCTTGCTCACCTTCAAAGTCTATGCAGCACCA
AAAAAGGACTCACCTCCCAAAAATTCCGTGAAGGTTGATGAGCTTTCACTCTACTCAGTTCC
TGAGGGTCAATCGAAGTATGTGGAGGAGGCAAGGAGCCAGCTTGAAGAAAGCATCTCACAGC
TCCGACACTATTGCGAGCCATACACAACCTGGTGTCAGGAAACGTACTCCCAAACTAAGCCC
AAGATGCAAAGTTTGGTTCAATGGGGGTTAGACAGCTATGACTATCTCCAAAATGCACCTCC
TGGATTTTTTCCGAGACTTGGTGTTATTGGTTTTGCTGGCCTTATTGGACTCCTTTTGGCTA
GAGGTTCAAAAATAAAGAAGCTAGTGTATCCGCCTGGTTTCATGGGATTAGCTGCCTCCCTC
TATTATCCACAACAAGCCATCGTGTTTGCCCAGGTCAGTGGGGAGAGATTATATGACTGGGG
TTTACGAGGATATATAGTCATAGAAGATTTGTGGAAGGAGAACTTTCAAAAGCCAGGAAATG
TGAAGAATTCACCTGGAACTAAGTAGAAAACTCCATGCTCTGCCATCTTAATCAGTTATAGG
TAAACATTGGAAACTCCATAGAATAAATCAGTATTTCTACAGAAAAATGGCATAGAAGTCAG
TATTGAATGTATTAAATTGGCTTTCTTCTTCAGGAAAAACTAGACCAGACCTCTGTTATCTT
CTGTGAAATCATCCTACAAGCAAACTAACCTGGAATCCCTTCACCTAGAGATAATGTACAAG
CCTTAGAACTCCTCATTCTCATGTTGCTATTTATGTACCTAATTAAAACCCAAGTTTAAAAA
AAAAAAAAAAAAAAAAAAAAAAAAAAAAAAAA

FIGURE 226

MFKVIQRSVGPASLSLLTFKVYAAPKKDSPPKNSVKVDELSLYSVPEGQSKYVEEARSQLEE
SISQLRHYCEPYTTWCQETYSQTKPKMQSLVQWGLDSYDYLQNAPPGFFPRLGVIGFAGLIG
LLLARGSKIKKLVYPPGFMGLAASLYYPQQAIVFAQVSGERLYDWGLRGYIVIEDLWKENFQ
KPGNVKNSPGTK

Important features:
Signal peptide:
Amino acids 1-23

Transmembrane domain:
Amino acids 111-130 cAMP- and cGMP-dependent protein kinase phosphorylation site:
Amino acids 26-30

Tyrosine kinase phosphorylation site:
Amino acids 36-44

N-myristoylation sites:
Amino acids 124-130;144-150;189-195

FIGURE 227

```
CACCGGAGGGCACGCAGCTGACGGAGCTGCGCTGCGTTCGCCTCGTTTGCCTCGCGCCCTCC
ACTGGAGCTGTTCGCGCCTCCCGGCTCCCACCGCAGCCCACCCGGCAGAGGAGTCGCTACCA
GCGCCCAGTGCGCTCTGTCAGTCCGCAAACTCCTTGCCGCCCGCCCCGGGCTGGGCACCAAA
TACCAGGCTACCATGGTCTACAAGACTCTCTTCGCTCTTTGCATCTTAACTGCAGGATGGAG
GGTACAGAGTCTGCCTACATCAGCTCCTTTGTCTGTTTCTCTTCCGACAAACATTGTACCAC
CGACCACCATCTGGACTAGCTCTCCACAAAACACTGATGCAGACACTGCCTCCCCATCCAAC
GGCACTCACAACAACTCGGTGCTCCCAGTTACAGCATCAGCCCCAACATCTCTGCTTCCTAA
GAACATTTCCATAGAGTCCAGAGAAGAGGAGATCACCAGCCCAGGTTCGAATTGGGAAGGCA
CAAACACAGACCCCTCACCTTCTGGGTTCTCGTCAACAAGCGGTGGAGTCCACTTAACAACC
ACGTTGGAGGAACACAGCTCGGGCACTCCTGAAGCAGGCGTGGCAGCTACACTGTCGCAGTC
CGCTGCTGAGCCTCCCACACTCATCTCCCCTCAAGCTCCAGCCTCATCACCCTCATCCCTAT
CAACCTCACCACCTGAGGTCTTTTCTGCCTCCGTTACTACCAACCATAGCTCCACTGTGACC
AGCACCCAACCCACTGGAGCTCCAACTGCACCAGAGTCCCCGACAGAGGAGTCCAGCTCTGA
CCACACACCCACTTCACATGCCACAGCTGAGCCAGTGCCCCAGGAGAAAACACCCCCAACAA
CTGTGTCAGGCAAAGTGATGTGTGAGCTCATAGACATGGAGACCACCACCACCTTTCCCAGG
GTGATCATGCAGGAAGTAGAACATGCATTAAGTTCAGGCAGCATCGCCGCCATTACCGTGAC
AGTCATTGCCGTGGTGCTGCTGGTGTTTGGAGTTGCAGCCTACCTAAAAATCAGGCATTCCT
CCTATGGAAGACTTTTGGACGACCATGACTACGGGTCCTGGGGAAACTACAACAACCCTCTG
TACGATGACTCCTAACAATGGAATATGGCCTGGGATGAGGATTAACTGTTCTTTATTTATAA
GTGCTTATCCAGTAGAATTAATAAGTACCTGATGCGCATTGAACGACAATCTTAAGCCCTGT
TTTGTTGGTATGGTTGTTTTTGTTTTCCTCCCTCTCCTCTGGCTGCTACAACTTCCCCTTTC
TGGTACAAGAAGAACCATTCTTTAAAGGTGAGTGGAGGCTGATTTGCAGCTGAAGTGGGCCA
GCCTTGCACCAGCCAGGCCAGACCACCATGGTGAAGGCTTCTTTCCCCACTGCAGGACCCAC
TTTGAGAAGGATCGAGGAGGAGGATTTGGGTTGTTTTGTTAGGGGTTACTTTCAGGGGAACA
TTTCATTTGTGTTATTTCTTAAACTTCTATTTAGGAAATTACATTAAGTATTAATGAGGGGA
AAGGAAATGAGCTCTACGAGGATTTCACCTTGCATGGGAGAGAGCAGGGTTTTCTCAGATTC
CTTTTTAATCTCTATTTATCTGGTTGTTTCTGACAGGATGCTGCCTGCTTGGCTCTACGAGC
TGGAAAGCAGCTTCTTAGCTGCCTAATTAATGAAAGATGAAAATAGGAAGTGCCCTGGAGGG
GGCCAGCAGGTCACGGGGCAGAATCTCTCAGGTTGCTGTGGGATCTCAGTGTGCCCCTACCT
GTTCTCCCCTCCAGGCCACCTGTCTCTGTAAAGGATGTCTGCTCTGTTCAAAAGGCAGCTGG
GATCCCAGCCCACAAGTGATCAGCAGAGTTGCATTTCCAAAGAAAAAGGCTATGAGATGAGC
TGAGTTATAGAGAGAAAGGGAGAGGCATGTACGGTGTGGGGAAGTGGAAGAGAAGCTGGCGG
GGGAGAAGGAGGCTAACCTGCACTGAGTACTTCATTAGGACAAGTGAGAATCAGCTATTGAT
AATGGCCAGAGATATCCACAGCTTGGAGGAGCCCAGAGACTGTTTGCTTTATACCCACACAG
CAACTGGTCCACTGCTTTACTGTCTGTTGGATAATGGCTGTAAATGTTTAAAAAC
```

FIGURE 228

MVYKTLFALCILTAGWRVQSLPTSAPLSVSLPTNIVPPTTIWTSSPQNTDADTASPSNGTHN
NSVLPVTASAPTSLLPKNISIESREEEITSPGSNWEGTNTDPSPSGFSSTSGGVHLTTTLEE
HSSGTPEAGVAATLSQSAAEPPTLISPQAPASSPSSLSTSPPEVFSASVTTNHSSTVTSTQP
TGAPTAPESPTEESSSDHTPTSHATAEPVPQEKTPPTTVSGKVMCELIDMETTTTFPRVIMQ
EVEHALSSGSIAAITVTVIAVVLLVFGVAAYLKIRHSSYGRLLDDHDYGSWGNYNNPLYDDS

Important features of the protein:
Signal peptide:
amino acids 1-20

Transmembrane domain:
amino acids 258-278

N-glycosylation sites.
amino acids 58-61, 62-65, 80-83, 176-179

Casein kinase II phosphorylation sites.
amino acids 49-52, 85-88, 95-98, 100-103, 120-123, 121-124, 141-144, 164-167, 191-194, 195-198, 200-203

Tyrosine kinase phosphorylation site.
amino acids 289-296

N-myristoylation sites.
amino acids 59-64, 115-120, 128-133, 133-138, 257-262, 297-302

FIGURE 229

```
CTCCTGCACTAGGCTCTCAGCCAGGGATGATGCGCTGCTGCCGCCGCCGCTGCTGCTGCCGG
CAACCACCCCATGCCCTGAGGCCGTTGCTGTTGCTGCCCTCGTCCTTTTACCTCCCCTGGC
AGCAGCTGCAGCGGGCCCAAACCGATGTGACACCATATACCAGGGCTTCGCCGAGTGTCTCA
TCCGCTTGGGGGACAGCATGGGCCGCGGAGGCGAGCTGGAGACCATCTGCAGGTCTTGGAAT
GACTTCCATGCCTGTGCCTCTCAGGTCCTGTCAGGCTGTCCGGAGGAGGCAGCTGCAGTGTG
GGAATCACTACAGCAAGAAGCTCGCCAGGCCCCCGTCCGAATAACTTGCACACTCTGTGCG
GTGCCCCGGTGCATGTTCGGGAGCGCGGCACAGGCTCCGAAACCAACCAGGAGACGCTGCGG
GCTACAGCGCCTGCACTCCCCATGGCCCCTGCGCCCCACTGCTGGCGGCTGCTCTGGCTCTG
GCCTACCTCCTGAGGCCTCTGGCCTAGCTTGTTGGGTTGGGTAGCAGCGCCCGTACCTCCAG
CCCTGCTCTGGCGGTGGTTGTCCAGGCTCTGCAGAGCGCAGCAGGGCTTTTCATTAAAGGTA
TTTATATTTGTA
```

FIGURE 230

></usr/seqdb2/sst/DNA/Dnaseqs.min/ss.DNA92265
><subunit 1 of 1, 165 aa, 1 stop
><MW: 17786, pI: 8.43, NX(S/T): 0
MMRCCRRRCCCRQPPHALRPLLLLPLVLLPPLAAAAAGPNRCDTIYQGFAECLIRLGDSM
GRGGELETICRSWNDFHACASQVLSGCPEEAAAVWESLQQEARQAPRPNNLHTLCGAPVH
VRERGTGSETNQETLRATAPALPMAPAPPLLAAALALAYLLRPLA Important features of the protein:
Signal peptide:
Amino acids    1-35

Transmembrane domain:
Amino acids    141-157

N-myristoylation site:
Amino acids    127-133

Prokaryotic membrane lipoprotein lipid attachment site:
Amino acids    77-88

FIGURE 231

AAGTACTTGTGTCCGGGTGGTGGACTGGATTAGCTGCGGAGCCCTGGAAGCTGCCTGTCCTT
CTCCCTGTGCTTAACCAGAGGTGCCCATGGGTTGGACAATGAGGCTGGTCACAGCAGCACTG
TTACTGGGTCTCATGATGGTGGTCACTGGAGACGAGGATGAGAACAGCCCGTGTGCCCATGA
GGCCCTCTTGGACGAGGACACCCTCTTTTGCCAGGGCCTTGAAGTTTTCTACCCAGAGTTGG
GGAACATTGGCTGCAAGGTTGTTCCTGATTGTAACAACTACAGACAGAAGATCACCTCCTGG
ATGGAGCCGATAGTCAAGTTCCCGGGGGCCGTGGACGGCGCAACCTATATCCTGGTGATGGT
GGATCCAGATGCCCCTAGCAGAGCAGAACCCAGACAGAGATTCTGGAGACATTGGCTGGTAA
CAGATATCAAGGGCGCCGACCTGAAGAAAGGGAAGATTCAGGGCCAGGAGTTATCAGCCTAC
CAGGCTCCCTCCCCACCGGCACACAGTGGCTTCCATCGCTACCAGTTCTTTGTCTATCTTCA
GGAAGGAAAAGTCATCTCTCTCCTTCCCAAGGAAAACAAAACTCGAGGCTCTTGGAAAATGG
ACAGATTTCTGAACCGCTTCCACCTGGGCGAACCTGAAGCAAGCACCCAGTTCATGACCCAG
AACTACCAGGACTCACCAACCCTCCAGGCTCCCAGAGGAAGGGCCAGCGAGCCCAAGCACAA
AACCAGGCAGAGATAGCTGCCTGCTAGATAGCCGGCTTTGCCATCCGGGCATGTGGCCACAC
TGCTCACCACCGACGATGTGGGTATGGAACCCCTCTGGATACAGAACCCCTTCTTTTCCAA
ATTAAAAAAAAAAATCATCAAA

FIGURE 232

```
></usr/seqdb2/sst/DNA/Dnaseqs.min/ss.DNA92274
><subunit 1 of 1, 223 aa, 1 stop
><MW: 25402, pI: 8.14, NX(S/T): 1
MGWTMRLVTAALLLGLMMVVTGDEDENSPCAHEALLDEDTLFCQGLEVFYPELGNIGCKVVP
DCNNYRQKITSWMEPIVKFPGAVDGATYILVMVDPDAPSRAEPRQRFWRHWLVTDIKGADLK
KGKIQGQELSAYQAPSPPAHSGFHRYQFFVYLQEGKVISLLPKENKTRGSWKMDRFLNRFHL
GEPEASTQFMTQNYQDSPTLQAPRGRASEPKHKTRQR
```

Important features of the protein:
Signal peptide:
amino acids 1-22

N-glycosylation site.
amino acids 169-173

Tyrosine kinase phosphorylation site.
amino acids 59-68

N-myristoylation sites.
amino acids 54-60, 83-89, 130-136

Phosphatidylethanolamine signature.
amino acids 113-157

FIGURE 233

```
AAGGAGCAGCCCGCAAGCACCAAGTGAGAGGATGAAGTTACAGTGTGTTTCCCTTTGGCTC
CTGGGTACAATACTGATATTGTGCTCAGTAGACAACCACGGTCTCAGGAGATGTCTGATTTC
CACAGACATGCACCATATAGAAGAGAGTTTCCAAGAAATCAAAAGAGCCATCCAAGCTAAGG
ACACCTTCCCAAATGTCACTATCCTGTCCACATTGGAGACTCTGCAGATCATTAAGCCCTTA
GATGTGTGCTGCGTGACCAAGAACCTCCTGGCGTTCTACGTGGACAGGGTGTTCAAGGATCA
TCAGGAGCCAAACCCCAAAATCTTGAGAAAAATCAGCAGCATTGCCAACTCTTTCCTCTACA
TGCAGAAAACTCTGCGGCAATGTCAGGAACAGAGGCAGTGTCACTGCAGGCAGGAAGCCACC
AATGCCACCAGAGTCATCCATGACAACTATGATCAGCTGGAGGTCCACGCTGCTGCCATTAA
ATCCCTGGGAGAGCTCGACGTCTTTCTAGCCTGGATTAATAAGAATCATGAAGTAATGTTCT
CAGCTTGATGACAAGGAACCTGTATAGTGATCCAGGGATGAACACCCCTGTGCGGTTTACT
GTGGGAGACAGCCCACCTTGAAGGGGAAGGAGATGGGGAAGGCCCCTTGCAGCTGAAAGTCC
CACTGGCTGGCCTCAGGCTGTCTTATTCCGCTTGAAAATAGGCAAAAAGTCTACTGTGGTAT
TTGTAATAAACTCTATCTGCTGAAAGGGCCTGCAGGCCATCCTGGGAGTAAAGGGCTGCCTT
CCCATCTAATTTATTGTAAAGTCATATAGTCCATGTCTGTGATGTGAGCCAAGTGATATCCT
GTAGTACACATTGTACTGAGTGGTTTTTCTGAATAAATTCCATATTTTACCTATGA
```

FIGURE 234

```
></usr/seqdb2/sst/DNA/Dnaseqs.full/ss.DNA92282
><subunit 1 of 1, 177 aa, 1 stop
><MW: 20452, pI: 8.00, NX(S/T): 2
MKLQCVSLWLLGTILILCSVDNHGLRRCLISTDMHHIEESFQEIKRAIQAKDTFPNVTILST
LETLQIIKPLDVCCVTKNLLAFYVDRVFKDHQEPNPKILRKISSIANSFLYMQKTLRQCQEQ
RQCHCRQEATNATRVIHDNYDQLEVHAAAIKSLGELDVFLAWINKNHEVMFSA
```

Signal sequence:
amino acids 1-18

N-glycosylation sites.
amino acids 56-60, 135-139 cAMP- and cGMP-dependent protein kinase phosphorylation site.
amino acids 102-106

N-myristoylation site.
amino acids 24-30

Actinin-type actin-binding domain signature 1.
amino acids 159-169

FIGURE 235

GCCCGGGCGGCTGCCCTTGGGTGCTCCCTTCCCTGCCCGACACCCAGACCGACCTTGACCGC
CCACCTGGCAGGAGCAGGACAGGACGGCCGGACGCGGCCATGGCCGAGCTCCCGGGGCCCTT
TCTCTGCGGGGCCCTGCTAGGCTTCCTGTGCCTGAGTGGGCTGGCCGTGGAGGTGAAGGTAC
CCACAGAGCCGCTGAGCACGCCCCTGGGGAAGACAGCCGAGCTGACCTGCACCTACAGCACG
TCGGTGGGAGACAGCTTCGCCCTGGAGTGGAGCTTTGTGCAGCCTGGGAAACCCATCTCTGA
GTCCATCCAATCCTGTACTTCACCAATGGCCATCTGTATCCAACTGGTTCTAAGTCAAAGC
GGGTCAGCCTGCTTCAGAACCCCCCACAGTGGGGGTGGCCACACTGAAACTGACTGACGTC
CACCCCTCAGATACTGGAACCTACCTCTGCCAAGTCAACAACCCACCAGATTTCTACACCAA
TGGGTTGGGGCTAATCAACCTTACTGTGCTGGTTCCCCCAGTAATCCCTTATGCAGTCAGA
GTGGACAAACCTCTGTGGGAGGCTCTACTGCACTGAGATGCAGCTCTTCCGAGGGGCTCCT
AAGCCAGTGTACAACTGGGTGCGTCTTGGAACTTTTCCTACACCTTCTCCTGGCAGCATGGT
TCAAGATGAGGTGTCTGGCCAGCTCATTCTCACCAACCTCTCCCTGACCTCCTCGGGCACCT
ACCGCTGTGTGGCCACCAACCAGATGGGCAGTGCATCCTGTGAGCTGACCCTCTCTGTGACC
GAACCCTCCCAAGGCCGAGTGGCCGGAGCTCTGATTGGGGTGCTCCTGGGCGTGCTGTTGCT
GTCAGTTGCTGCGTTCTGCCTGGTCAGGTTCCAGAAAGAGAGGGGGAAGAAGCCCAAGGAGA
CATATGGGGGTAGTGACCTTCGGGAGGATGCCATCGCTCCTGGGATCTCTGAGCACACTTGT
ATGAGGGCTGATTCTAGCAAGGGGTTCCTGGAAAGACCCTCGTCTGCCAGCACCGTGACGAC
CACCAAGTCCAAGCTCCCTATGGTCGTGTGACTTCTCCCGATCCCTGAGGGCGGTGAGGGGG
AATATCAATAATTAAAGTCTGTGGGTACCCTTNAAAAAAAAAAA

FIGURE 236

```
></usr/seqdb2/sst/DNA/Dnaseqs.min/ss.DNA108760
><subunit 1 of 1, 327 aa, 1 stop
><MW: 34348, pI: 7.88, NX(S/T): 2
MAELPGPFLCGALLGFLCLSGLAVEVKVPTEPLSTPLGKTAELTCTYSTSVGDSFALEWS
FVQPGKPISESHPILYFTNGHLYPTGSKSKRVSLLQNPPTVGVATLKLTDVHPSDTGTYL
CQVNNPPDFYTNGLGLINLTVLVPPSNPLCSQSGQTSVGGSTALRCSSSEGAPKPVYNWV
RLGTFPTPSPGSMVQDEVSGQLILTNLSLTSSGTYRCVATNQMGSASCELTLSVTEPSQG
RVAGALIGVLLGVLLLSVAAFCLVRFQKERGKKPKETYGGSDLREDAIAPGISEHTCMRA
DSSKGFLERPSSASTVTTTKSKLPMVV
```

Important features of the protein:
Signal peptide:
Amino acids    1-20

Transmembrane domain:
Amino acids    242-260

N-glycosylation sites:
Amino acids    138-142;206-210 cAMP- and cGMP-dependent protein kinase phosphorylation site:
Amino acids    90-94

N-myristoylation sites:
Amino acids    11-17;117-123;159-165;213-219;224-230;244-250;
               248-254

Amidation site:
Amino acids    270-274

Prokaryotic membrane lipoprotein lipid attachment site:
Amino acids    218-229

FIGURE 237

```
GGATGCAGCAGAGAGGAGCAGCTGGAAGCCGTGGCTGCGCTCTCTTCCCTCTGCTGGGCG
TCCTGTTCTTCCAGGGTGTTTATATCGTCTTTTCCTTGGAGATTCGTGCAGATGCCCATG
TCCGAGGTTATGTTGGAGAAAAGATCAAGTTGAAATGCACTTTCAAGTCAACTTCAGATG
TCACTGACAAGCTTACTATAGACTGGACATATCGCCCTCCCAGCAGCAGCCACACAGTAT
CAATATTTCATTATCAGTCTTTCCAGTACCCAACCACAGCAGGCACATTTCGGGATCGGA
TTTCCTGGGTTGGAAATGTATACAAAGGGGATGCATCTATAAGTATAAGCAACCCTACCA
TAAAGGACAATGGGACATTCAGCTGTGCTGTGAAGAATCCCCAGATGTGCACCATAATA
TTCCCATGACAGAGCTAACAGTCACAGAAAGGGGTTTTGGCACCATGCTTTCCTCTGTGG
CCCTTCTTTCCATCCTTGTCTTTGTGCCCTCAGCCGTGGTGGTTGCTCTGCTGCTGGTGA
GAATGGGGAGGAAGGCTGCTGGGCTGAAGAAGAGGAGCAGGTCTGGCTATAAGAAGTCAT
CTATTGAGGTTTCCGATGACACTGATCAGGAGGAGGAAGAGGCGTGTATGGCGAGGCTTT
GTGTCCGTTGCGCTGAGTGCCTGGATTCAGACTATGAAGAGACATATTGATGAAAGTCTG
TATGACACAAGAAGAGTCACCTAAAGACAGGAAACATCCCATTCCACTGGCAGCTAAAGC
CTGTCAGAGAAAGTGGAGCTGGCCTGGACCATAGCGATGGACAATCCTGGAGATCATCAG
TAAAGACTTTAGGAACCACTTATTTATTGAATAAATGTTCTTGTTGTATTTATAAACTGT
TCAGGAAGTCTCATAAGAGACTCATGACTTCCCCTTTCAATGAATTATGCTGTAATTGAA
TGAAGAAATTCTTTTCCTGAGCA
```

FIGURE 238

MQQRGAAGSRGCALFPLLGVLFFQGVYIVFSLEIRADAHVRGYVGEKIKLKCTFKSTSD
VTDKLTIDWTYRPPSSSHTVSIFHYQSFQYPTTAGTFRDRISWVGNVYKGDASISISNP
TIKDNGTFSCAVKNPPDVHHNIPMTELTVTERGFGTMLSSVALLSILVFVPSAVVVALL
LVRMGRKAAGLKKRSRSGYKKSSIEVSDDTDQEEEEACMARLCVRCAECLDSDYEETY

Transmembrane domain
    11-30
    157-177

N-glycosylation site
    123-127 cAMP- and cGMP-dependent protein kinase phosphorylation site
    189-193
    197-201

Tyrosine kinase phosphorylation site
    63-71

N-myristoylation site
    5-11
    8-14
    124-130
    153-159

Amidation site
    181-185

FIGURE 239

CAGGCGGGCCCCCGCGCGGCAGGGCCCTGGACCCGCGCGGCTCCCGGGGATGGTGAGCAAGGCGCTGCTGCGCC
TCGTGTCTGCCGTCAACCGCAGGAGGATGAAGCTGCTGCTGGGCATCGCCTTGCTGGCCTACGTCGCCTCTGTT
TGGGGCAACTTCGTTAATATGAGGTCTATCCAGGAAAATGGTGAACTAAAAATTGAAAGCAAGATTGAAGAGAT
GGTTGAACCACTAAGAGAGAAAATCAGAGATTTAGAAAAAAGCTTTACCCAGAAATACCCACCAGTAAAGTTTT
TATCAGAAAAGGATCGGAAAAGAATTTTGATAACAGGAGGCGCAGGGTTCGTGGGCTCCCATCTAACTGACAAA
CTCATGATGGACGGCCACGAGGTGACCGTGGTGGACAATTTCTTCACGGGCAGGAAGAGAAACGTGGAGCACTG
GATCGGACATGAGAACTTCGAGTTGATTAACCACGACGTGGTGGAGCCCCTCTACATCGAGGTTGACCAGATAT
ACCATCTGGCATCTCCAGCCTCCCCTCCAAACTACATGTATAATCCTATCAAGACATTAAAGACCAATACGATT
GGGACATTAAACATGTTGGGGCTGGCAAAACGAGTCGGTGCCCGTCTGCTCCTGGCCTCCACATCGGAGGTGTA
TGGAGATCCTGAAGTCCACCCTCAAAGTGAGGATTACTGGGGCCACGTGAATCCAATAGGACCTCGGGCCTGCT
ACGATGAAGGCAAACGTGTTGCAGAGACCATGTGCTATGCCTACATGAAGCAGGAAGGCGTGGAAGTGCGAGTG
GCCAGAATCTTCAACACCTTTGGGCCACGCATGCACATGAACGATGGGCGAGTAGTCAGCAACTTCATCCTGCA
GGCGCTCCAGGGGGAGCCACTCACGGTATACGGATCCGGGTCTCAGACAAGGGCGTTCCAGTACGTCAGCGATC
TAGTGAATGGCCTCGTGGCTCTCATGAACAGCAACGTCAGCAGCCCGGTCAACCTGGGGAACCCAGAAGAACAC
ACAATCCTAGAATTTGCTCAGTTAATTAAAAACCTTGTTGGTAGCGGAAGTGAAATTCAGTTTCTCTCCGAAGC
CCAGGATGACCCACAGAAAAGAAAACCAGACATCAAAAAAGCAAAGCTGATGCTGGGGTGGGAGCCCGTGGTCC
CGCTGGAGGAAGGTTTAAACAAAGCAATTCACTACTTCCGTAAAGAACTCGAGTACCAGGCAAATAATCAGTAC
ATCCCCAAACCAAAGCCTGCCAGAATAAAGAAAGGACGGACTCGCCACAGCTGAACTCCTCACTTTTAGGACAC
AAGACTACCATTGTACACTTGATGGGATGTATTTTTGGCTTTTTTTTGTTGTCGTTTAAAGAAAGACTTTAACA
GGTGTCATGAAGAACAAACTGGAATTTCATTCTGAAGCTTGCTTTAATGAAATGGATGTGCCTAAAAGCTCCCC
TCAAAAAACTGCAGATTTTTGCCTTGCACTTTTTGAATCTCTCTTTTTATGTAAAATAGCGTAGATGCATCTCTG
CGTATTTTCAAGTTTTTTTATCTTGCTGTGAGAGCATATGTTGTGACTGTCGTTGACAGTTTTATTTACTGGTT
TCTTTGTGAAGCTGAAAAGGAACATTAAGCGGGACAAAAAATGCCGATTTTATTTATAAAAGTGGGTACTTAAT
AAATGAGTCGTTATACTATGCATAAAGAAAAATCCTAGCAGTATTGTCAGGTGGTGGTGCGCCGGCATTGATTT
TAGGGCAGATAAAAGAATTCTGTGTGAGAGCTTTATGTTTCTCTTTTAATTCAGAGTTTTTCCAACGTCTACTT
TTGAGTTGCAAACTTGACTTTGAAATATTCCTGTTGGTCATGATCAAGGATATTTGAAATCACTACTGTGTTTT
GCTGCGTATCTGGGGCGGGGGCAGGTTGGGGGGCACAAAGTTAACATATTCTTGGTTAACCATGGTTAAATATG
CTATTTTAATAAAATATTGAAACTCA

FIGURE 240

MVSKALLRLVSAVNRRRMKLLLGIALLAYVASVWGNFVNMRSIQENGELKIESKIEEMVEPL
REKIRDLEKSFTQKYPPVKFLSEKDRKRILITGGAGFVGSHLTDKLMMDGHEVTVVDNFFTG
RKRNVEHWIGHENFELINHDVVEPLYIEVDQIYHLASPASPPNYMYNPIKTLKTNTIGTLNM
LGLAKRVGARLLLASTSEVYGDPEVHPQSEDYWGHVNPIGPRACYDEGKRVAETMCYAYMKQ
EGVEVRVARIFNTFGPRMHMNDGRVVSNFILQALQGEPLTVYGSGSQTRAFQYVSDLVNGLV
ALMNSNVSSPVNLGNPEEHTILEFAQLIKNLVGSGSEIQFLSEAQDDPQKRKPDIKKAKLML
GWEPVVPLEEGLNKAIHYFRKELEYQANNQYIPKPKPARIKKGRTRHS

Important features:
Signal peptide:
amino acids 1-32

N-glycosylation site:
amino acids 316-320

Tyrosine kinase phosphorylation site:
amino acids 235-244

N-myristoylation sites:
amino acids 35-41,101-107,383-389

Amidation sites:
amino acids 123-127,233-237

FIGURE 241

```
GCCCGGTGGAGAATTAGGTGCTGCTGGGAGCTCCTGCCTCCCACAGGATTCCAGCTGCAGGG
AGCCTCAGGGACTCTGGGCCGCACGGAGTTGGGGGCATTCCCCAGAGAGCGTCGCCATGGTC
TGCAGGGAGCAGTTATCAAAGAATCAGGTCAAGTGGGTGTTTGCCGGCATTACCTGTGTGTC
TGTGGTGGTCATTGCCGCAATAGTCCTTGCCATCACCCTGCGGCGGCCAGGCTGTGAGCTGG
AGGCCTGCAGCCCTGATGCCGACATGCTGGACTACCTGCTGAGCCTGGGCCAGATCAGCCGG
CGAGATGCCTTGGAGGTCACCTGGTACCACGCAGCCAACAGCAAGAAAGCCATGACAGCTGC
CCTGAACAGCAACATCACAGTCCTGGAGGCTGACGTCAATGTAGAAGGGCTCGGCACAGCCA
ATGAGACAGGAGTTCCCATCATGGCACACCCCCCACTATCTACAGTGACAACACACTGGAG
CAGTGGCTGGACGCTGTGCTGGGCTCTTCCCAAAAGGGCATCAAACTGGACTTCAAGAACAT
CAAGGCAGTGGGCCCCTCCCTGGACCTCCTGCGGCAGCTGACAGAGGAAGGCAAAGTCCGGC
GGCCCATATGGATCAACGCTGACATCTTAAAGGGCCCCAACATGCTCATCTCAACTGAGGTC
AATGCCACACAGTTCCTGGCCCTGGTCCAGGAGAAGTATCCCAAGGCTACCCTATCTCCAGG
CTGGACCACCTTCTACATGTCCACGTCCCCAAACAGGACGTACACCCAAGCCATGGTGGAGA
AGATGCACGAGCTGGTGGGAGGAGTGCCCCAGAGGGTCACCTTCCCTGTACGGTCTTCCATG
GTGCGGGCTGCCTGGCCCCACTTCAGCTGGCTGCTGAGCCAATCTGAGAGGTACAGCCTGAC
GCTGTGGCAGGCTGCCTCGGACCCCATGTCGGTGGAAGATCTGCTCTACGTCCGGGATAACA
CTGCTGTCCACCAAGTCTACTATGACATCTTTGAGCCTCTCCTGTCACAGTTCAAGCAGCTG
GCCTTGAATGCCACACGGAAACCAATGTACTACACGGGAGGCAGCCTGATCCCTCTTCTCCA
GCTGCCTGGGGATGACGGTCTGAATGTGGAGTGGCTGGTTCCTGACGTCCAGGGCAGCGGTA
AAACAGCAACAATGACCCTCCCAGACACAGAAGGCATGATCCTGCTGAACACTGGCCTCGAG
GGAACTGTGGCTGAAAACCCCGTGCCCATTGTTCATACTCCAAGTGGCAACATCCTGACGCT
GGAGTCCTGCCTGCAGCAGCTGGCCACACATCCCGGACACTGGGGCATCCATTTGCAAATAG
TGGAGCCCGCAGCCCTCCGGCCATCCCTGGCCTTGCTGGCACGCCTCTCCAGCCTTGGCCTC
TTGCATTGGCCTGTGTGGGTTGGGGCCAAAATCTCCCACGGGAGTTTTTCGGTCCCCGGCCA
TGTGGCTGGCAGAGAGCTGCTTACAGCTGTGGCTGAGGTCTTCCCCCACGTGACTGTGGCAC
CAGGCTGGCCTGAGGAGGTGCTGGGCAGTGGCTACAGGGAACAGCTGCTCACAGATATGCTA
GAGTTGTGCCAGGGGCTCTGGCAACCTGTGTCCTTCCAGATGCAGGCCATGCTGCTGGGCCA
CAGCACAGCTGGAGCCATAGGCAGGCTGCTGGCATCCTCCCCCCGGGCCACCGTCACAGTGGAG
CACAACCCAGCTGGGGGCGACTATGCCTCTGTGAGGACAGCATTGCTGGCAGCTAGGGCTGT
GGACAGGACCCGAGTCTACTACAGGCTACCCCAGGGCTACCACAAGGACTTGCTGGCTCATG
TTGGTAGAAACTGAGCACCCAGGGGTGGTGGGCCAGCGGACCTCAGGGCGGAGGCTTCCCAC
GGGGAGGCAGGAAGAAATAAAGGTCTTTGGCTTTCTCCAGGCAAAAAAAAAAAAAAAAAAAA
AAAAAAAAAAAAAAAAAAAAAAAAAAAAAAAAAAG
```

FIGURE 242

```
></usr/seqdb2/sst/DNA/Dnaseqs.min/ss.DNA119514
><subunit 1 of 1, 585 aa, 1 stop
><MW: 64056, pI: 6.58, NX(S/T): 5
MVCREQLSKNQVKWVFAGITCVSVVVIAAIVLAITLRRPGCELEACSPDADMLDYLLSLG
QISRRDALEVTWYHAANSKKAMTAALNSNITVLEADVNVEGLGTANETGVPIMAHPPTIY
SDNTLEQWLDAVLGSSQKGIKLDFKNIKAVGPSLDLLRQLTEEGKVRRPIWINADILKGP
NMLISTEVNATQFLALVQEKYPKATLSPGWTTFYMSTSPNRTYTQAMVEKMHELVGGVPQ
RVTFPVRSSMVRAAWPHFSWLLSQSERYSLTLWQAASDPMSVEDLLYVRDNTAVHQVYYD
IFEPLLSQFKQLALNATRKPMYYTGGSLIPLLQLPGDDGLNVEWLVPDVQGSGKTATMTL
PDTEGMILLNTGLEGTVAENPVPIVHTPSGNILTLESCLQQLATHPGHWGIHLQIVEPAA
LRPSLALLARLSSLGLLHWPVWVGAKISHGSFSVPGHVAGRELLTAVAEVFPHVTVAPGW
PEEVLGSGYREQLLTDMLELCQGLWQPVSFQMQAMLLGHSTAGAIGRLLASSPRATVTVE
HNPAGGDYASVRTALLAARAVDRTRVYYRLPQGYHKDLLAHVGRN Important features of the protein:
Transmembrane domain:
Amino acids     18-37    (Possible type II)

N-glycosylation sites:
Amino acids     89-93;106-110;189-193;220-224;315-319

Tyrosine kinase phosphorylation site:
Amino acids     65-74

N-myristoylation sites:
Amino acids     101-107;351-357;372-378;390-396;444-450;545-551

Aminotransferases class-V pyridoxal-phosphate attachment site:
Amino acids     312-330
```

FIGURE 243

```
CTTCAGAACAGGTTCTCCTTCCCCAGTCACCAGTTGCTCGAGTTAGAATTGTCTGCAATGGC
CGCCCTGCAGAAATCTGTGAGCTCTTTCCTTATGGGGACCCTGGCCACCAGCTGCCTCCTTC
TCTTGGCCCTCTTGGTACAGGGAGGAGCAGCTGCGCCCATCAGCTCCCACTGCAGGCTTGAC
AAGTCCAACTTCCAGCAGCCCTATATCACCAACCGCACCTTCATGCTGGCTAAGGAGGCTAG
CTTGGCTGATAACAACACAGACGTTCGTCTCATTGGGGAGAAACTGTTCCACGGAGTCAGTA
TGAGTGAGCGCTGCTATCTGATGAAGCAGGTGCTGAACTTCACCCTTGAAGAAGTGCTGTTC
CCTCAATCTGATAGGTTCCAGCCTTATATGCAGGAGGTGGTGCCCTTCCTGGCCAGGCTCAG
CAACAGGCTAAGCACATGTCATATTGAAGGTGATGACCTGCATATCCAGAGGAATGTGCAAA
AGCTGAAGGACACAGTGAAAAAGCTTGGAGAGAGTGGAGAGATCAAAGCAATTGGAGAACTG
GATTTGCTGTTTATGTCTCTGAGAAATGCCTGCATTTGACCAGAGCAAAGCTGAAAAATGAA
TAACTAACCCCCTTTCCCTGCTAGAAATAACAATTAGATGCCCCAAAGCGATTTTTTTTAAC
CAAAAGGAAGATGGGAAGCCAAACTCCATCATGATGGGTGGATTCCAAATGAACCCCTGCGT
TAGTTACAAAGGAAACCAATGCCACTTTTGTTTATAAGACCAGAAGGTAGACTTTCTAAGCA
TAGATATTTATTGATAACATTTCATTGTAACTGGTGTTCTATACACAGAAAACAATTTATTT
TTTAAATAATTGTCTTTTTCCATAAAAAAGATTACTTTCCATTCCTTTAGGGGAAAAAACCC
CTAAATAGCTTCATGTTTCCATAATCAGTACTTTATATTTATAAATGTATTTATTATTATTA
TAAGACTGCATTTTATTTATATCATTTTATTAATATGGATTTATTTATAGAAACATCATTCG
ATATTGCTACTTGAGTGTAAGGCTAATATTGATATTTATGACAATAATTATAGAGCTATAAC
ATGTTTATTTGACCTCAATAAACACTTGGATATCCC
```

FIGURE 244

MAALQKSVSSFLMGTLATSCLLLLALLVQGGAAAPISSHCRLDKSNFQQPYITNRTFMLAKE
ASLADNNTDVRLIGEKLFHGVSMSERCYLMKQVLNFTLEEVLFPQSDRFQPYMQEVVPFLAR
LSNRLSTCHIEGDDLHIQRNVQKLKDTVKKLGESGEIKAIGELDLLFMSLRNACI

Important features of the protein:
Signal peptide:
amino acids 1-33

N-glycosylation sites.
amino acids 54-58, 68-72, 97-101

N-myristoylation sites.
amino acids 14-20, 82-88

Prokaryotic membrane lipoprotein lipid attachment site.
amino acids 10-21

PRO9799 POLYPEPTIDES

RELATED APPLICATIONS

This is a continuation application claiming priority under 35 USC § 120 to U.S. Ser. No. 10/119,480 filed Apr. 9, 2002, now abandoned which is a continuation under 35 USC § 120 of international application PCT/US01/21066 filed Jun. 29, 2001, which is a continuation-in-part of international application PCT/US01/17800 filed Jun. 1, 2001, which claims priority under 35 USC § 119 to U.S. provisional application No. 60/222,425 filed Aug. 1, 2000.

FIELD OF THE INVENTION

The present invention relates generally to the identification and isolation of novel DNA and to the recombinant production of novel polypeptides.

BACKGROUND OF THE INVENTION

Extracellular proteins play important roles in, among other things, the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. These secreted polypeptides or signaling molecules normally pass through the cellular secretory pathway to reach their site of action in the extracellular environment.

Secreted proteins have various industrial applications, including as pharmaceuticals, diagnostics, biosensors and bioreactors. Most protein drugs available at present, such as thrombolytic agents, interferons, interleukins, erythropoietins, colony stimulating factors, and various other cytokines, are secretory proteins. Their receptors, which are membrane proteins, also have potential as therapeutic or diagnostic agents. Efforts are being undertaken by both industry and academia to identify new, native secreted proteins. Many efforts are focused on the screening of mammalian recombinant DNA libraries to identify the coding sequences for novel secreted proteins. Examples of screening methods and techniques are described in the literature [see, for example, Klein et al., *Proc. Natl. Acad. Sci.* 93:7108-7113 (1996); U.S. Pat. No. 5,536,637)].

Membrane-bound proteins and receptors can play important roles in, among other things, the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. Such membrane-bound proteins and cell receptors include, but are not limited to, cytokine receptors, receptor kinases, receptor phosphatases, receptors involved in cell-cell interactions, and cellular adhesin molecules like selectins and integrins. For instance, transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Membrane-bound proteins and receptor molecules have various industrial applications, including as pharmaceutical and diagnostic agents. Receptor immunoadhesins, for instance, can be employed as therapeutic agents to block receptor-ligand interactions. The membrane-bound proteins can also be employed for screening of potential peptide or small molecule inhibitors of the relevant receptor/ligand interaction.

Efforts are being undertaken by both industry and academia to identify new, native receptor or membrane-bound proteins. Many efforts are focused on the screening of mammalian recombinant DNA libraries to identify the coding sequences for novel receptor or membrane-bound proteins.

SUMMARY OF THE INVENTION

In one embodiment, the invention provides an isolated nucleic acid molecule comprising a nucleotide sequence that encodes a PRO polypeptide.

In one aspect, the isolated nucleic acid molecule comprises a nucleotide sequence having at least about 80% nucleic acid sequence identity, alternatively at least about 81% nucleic acid sequence identity, alternatively at least about 82% nucleic acid sequence identity, alternatively at least about 83% nucleic acid sequence identity, alternatively at least about 84% nucleic acid sequence identity, alternatively at least about 85% nucleic acid sequence identity, alternatively at least about 86% nucleic acid sequence identity, alternatively at least about 87% nucleic acid sequence identity, alternatively at least about 88% nucleic acid sequence identity, alternatively at least about 89% nucleic acid sequence identity, alternatively at least about 90% nucleic acid sequence identity, alternatively at least about 91% nucleic acid sequence identity, alternatively at least about 92% nucleic acid sequence identity, alternatively at least about 93% nucleic acid sequence identity, alternatively at least about 94% nucleic acid sequence identity, alternatively at least about 95% nucleic acid sequence identity, alternatively at least about 96% nucleic acid sequence identity, alternatively at least about 97% nucleic acid sequence identity, alternatively at least about 98% nucleic acid sequence identity and alternatively at least about 99% nucleic acid sequence identity to (a) a DNA molecule encoding a PRO polypeptide having a full-length amino acid sequence as disclosed herein, an amino acid sequence lacking the signal peptide as disclosed herein, an extracellular domain of a transmembrane protein, with or without the signal peptide, as disclosed herein or any other specifically defined fragment of the full-length amino acid sequence as disclosed herein, or (b) the complement of the DNA molecule of (a).

In other aspects, the isolated nucleic acid molecule comprises a nucleotide sequence having at least about 80% nucleic acid sequence identity, alternatively at least about 81% nucleic acid sequence identity, alternatively at least about 82% nucleic acid sequence identity, alternatively at least about 83% nucleic acid sequence identity, alternatively at least about 84% nucleic acid sequence identity, alternatively at least about 85% nucleic acid sequence identity, alternatively at least about 86% nucleic acid sequence identity, alternatively at least about 87% nucleic acid sequence identity, alternatively at least about 88% nucleic acid sequence identity, alternatively at least about 89% nucleic acid sequence identity, alternatively at least about 90% nucleic acid sequence identity, alternatively at least about 91% nucleic acid sequence identity, alternatively at least about 92% nucleic acid sequence identity, alternatively at least about 93% nucleic acid sequence identity, alternatively at least about 94% nucleic acid sequence identity, alternatively at least about 95% nucleic acid sequence identity, alternatively at least about 96% nucleic acid sequence identity, alternatively at least about 97% nucleic acid sequence identity, alternatively at least about 98% nucleic acid sequence identity and alternatively at least about 99% nucleic acid sequence identity to (a) a DNA molecule comprising the coding sequence of a full-length PRO polypeptide cDNA as disclosed herein, the coding sequence of a PRO polypeptide lacking the signal peptide as disclosed herein, the coding sequence of an extracellular domain of a transmembrane PRO polypeptide, with or without the signal peptide, as disclosed herein or the coding sequence of any other specifically defined fragment of the full-length amino acid sequence as disclosed herein, or (b) the complement of the DNA molecule of (a).

In a further aspect, the invention concerns an isolated nucleic acid molecule comprising a nucleotide sequence having at least about 80% nucleic acid sequence identity, alternatively at least about 81% nucleic acid sequence identity, alternatively at least about 82% nucleic acid sequence identity, alternatively at least about 83% nucleic acid sequence identity, alternatively at least about 84% nucleic acid sequence identity, alternatively at least about 85% nucleic acid sequence identity, alternatively at least about 86% nucleic acid sequence identity, alternatively at least about 87% nucleic acid sequence identity, alternatively at least about 88% nucleic acid sequence identity, alternatively at least about 89% nucleic acid sequence identity, alternatively at least about 90% nucleic acid sequence identity, alternatively at least about 91% nucleic acid sequence identity, alternatively at least about 92% nucleic acid sequence identity, alternatively at least about 93% nucleic acid sequence identity, alternatively at least about 94% nucleic acid sequence identity, alternatively at least about 95% nucleic acid sequence identity, alternatively at least about 96% nucleic acid sequence identity, alternatively at least about 97% nucleic acid sequence identity, alternatively at least about 98% nucleic acid sequence identity and alternatively at least about 99% nucleic acid sequence identity to (a) a DNA molecule that encodes the same mature polypeptide encoded by any of the human protein cDNAs deposited with the ATCC as disclosed herein, or (b) the complement of the DNA molecule of (a).

Another aspect the invention provides an isolated nucleic acid molecule comprising a nucleotide sequence encoding a PRO polypeptide which is either transmembrane domain-deleted or transmembrane domain-inactivated, or is complementary to such encoding nucleotide sequence, wherein the transmembrane domain(s) of such polypeptide are disclosed herein. Therefore, soluble extracellular domains of the herein described PRO polypeptides are contemplated.

Another embodiment is directed to fragments of a PRO polypeptide coding sequence, or the complement thereof, that may find use as, for example, hybridization probes, for encoding fragments of a PRO polypeptide that may optionally encode a polypeptide comprising a binding site for an anti-PRO antibody or as antisense oligonucleotide probes. Such nucleic acid fragments are usually at least about 10 nucleotides in length, alternatively at least about 15 nucleotides in length, alternatively at least about 20 nucleotides in length, alternatively at least about 30 nucleotides in length, alternatively at least about 40 nucleotides in length, alternatively at least about 50 nucleotides in length, alternatively at least about 60 nucleotides in length, alternatively at least about 70 nucleotides in length, alternatively at least about 80 nucleotides in length, alternatively at least about 90 nucleotides in length, alternatively at least about 100 nucleotides in length, alternatively at least about 110 nucleotides in length, alternatively at least about 120 nucleotides in length, alternatively at least about 130 nucleotides in length, alternatively at least about 140 nucleotides in length, alternatively at least about 150 nucleotides in length, alternatively at least about 160 nucleotides in length, alternatively at least about 170 nucleotides in length, alternatively at least about 180 nucleotides in length, alternatively at least about 190 nucleotides in length, alternatively at least about 200 nucleotides in length, alternatively at least about 250 nucleotides in length, alternatively at least about 300 nucleotides in length, alternatively at least about 350 nucleotides in length, alternatively at least about 400 nucleotides in length, alternatively at least about 450 nucleotides in length, alternatively at least about 500 nucleotides in length, alternatively at least about 600 nucleotides in length, alternatively at least about 700 nucleotides in length, alternatively at least about 800 nucleotides in length, alternatively at least about 900 nucleotides in length and alternatively at least about 1000 nucleotides in length, wherein in this context the term "about" means the referenced nucleotide sequence length plus or minus 10% of that referenced length. It is noted that novel fragments of a PRO polypeptide-encoding nucleotide sequence may be determined in a routine manner by aligning the PRO polypeptide-encoding nucleotide sequence with other known nucleotide sequences using any of a number of well known sequence alignment programs and determining which PRO polypeptide-encoding nucleotide sequence fragment(s) are novel. All of such PRO polypeptide-encoding nucleotide sequences are contemplated herein. Also contemplated are the PRO polypeptide fragments encoded by these nucleotide molecule fragments, preferably those PRO polypeptide fragments that comprise a binding site for an anti-PRO antibody.

In another embodiment, the invention provides isolated PRO polypeptide encoded by any of the isolated nucleic acid sequences hereinabove identified.

In a certain aspect, the invention concerns an isolated PRO polypeptide, comprising an amino acid sequence having at least about 80% amino acid sequence identity, alternatively at least about 81% amino acid sequence identity, alternatively at least about 82% amino acid sequence identity, alternatively at least about 83% amino acid sequence identity, alternatively at least about 84% amino acid sequence identity, alternatively at least about 85% amino acid sequence identity, alternatively at least about 86% amino acid sequence identity, alternatively at least about 87% amino acid sequence identity, alternatively at least about 88% amino acid sequence identity, alternatively at least about 89% amino acid sequence identity, alternatively at least about 90% amino acid sequence identity, alternatively at least about 91% amino acid sequence identity, alternatively at least about 92% amino acid sequence identity, alternatively at least about 93% amino acid sequence identity, alternatively at least about 94% amino acid sequence identity, alternatively at least about 95% amino acid sequence identity, alternatively at least about 96% amino acid sequence identity, alternatively at least about 97% amino acid sequence identity, alternatively at least about 98% amino acid sequence identity and alternatively at least about 99% amino acid sequence identity to a PRO polypeptide having a full-length amino acid sequence as disclosed herein, an amino acid sequence lacking the signal peptide as disclosed herein, an extracellular domain of a transmembrane protein, with or without the signal peptide, as disclosed herein or any other specifically defined fragment of the full-length amino acid sequence as disclosed herein.

In a further aspect, the invention concerns an isolated PRO polypeptide comprising an amino acid sequence having at least about 80% amino acid sequence identity, alternatively at least about 81% amino acid sequence identity, alternatively at least about 82% amino acid sequence identity, alternatively at least about 83% amino acid sequence identity, alternatively at least about 84% amino acid sequence identity, alternatively at least about 85% amino acid sequence identity, alternatively at least about 86% amino acid sequence identity, alternatively at least about 87% amino acid sequence identity, alternatively at least about 88% amino acid sequence identity, alternatively at least about 89% amino acid sequence identity, alternatively at least about 90% amino acid sequence identity, alternatively at least about 91% amino acid sequence identity, alternatively at least about 92% amino acid sequence identity, alternatively at least about 93% amino acid sequence identity, alternatively at least about 94% amino acid sequence identity, alternatively at least about 95% amino acid sequence identity, alternatively at least about 96% amino acid sequence identity, alternatively at least about 97% amino acid sequence identity, alternatively at least about 98% amino acid sequence identity and alternatively at least about 99% amino acid sequence identity to an amino acid sequence encoded by any of the human protein cDNAs deposited with the ATCC as disclosed herein.

In a specific aspect, the invention provides an isolated PRO polypeptide without the N-terminal signal sequence and/or the initiating methionine and is encoded by a nucleotide sequence that encodes such an amino acid sequence as hereinbefore described. Processes for producing the same are also herein described, wherein those processes comprise culturing a host cell comprising a vector which comprises the appropriate encoding nucleic acid molecule under conditions suitable for expression of the PRO polypeptide and recovering the PRO polypeptide from the cell culture.

Another aspect the invention provides an isolated PRO polypeptide which is either transmembrane domain-deleted or transmembrane domain-inactivated. Processes for producing the same are also herein described, wherein those processes comprise culturing a host cell comprising a vector which comprises the appropriate encoding nucleic acid molecule under conditions suitable for expression of the PRO polypeptide and recovering the PRO polypeptide from the cell culture.

In yet another embodiment, the invention concerns agonists and antagonists of a native PRO polypeptide as defined herein. In a particular embodiment, the agonist or antagonist is an anti-PRO antibody or a small molecule.

In a further embodiment, the invention concerns a method of identifying agonists or antagonists to a PRO polypeptide which comprise contacting the PRO polypeptide with a candidate molecule and monitoring a biological activity mediated by said PRO polypeptide. Preferably, the PRO polypeptide is a native PRO polypeptide.

In a still further embodiment, the invention concerns a composition of matter comprising a PRO polypeptide, or an agonist or antagonist of a PRO polypeptide as herein described, or an anti-PRO antibody, in combination with a carrier. Optionally, the carrier is a pharmaceutically acceptable carrier.

Another embodiment of the present invention is directed to the use of a PRO polypeptide, or an agonist or antagonist thereof as hereinbefore described, or an anti-PRO antibody, for the preparation of a medicament useful in the treatment of a condition which is responsive to the PRO polypeptide, an agonist or antagonist thereof or an anti-PRO antibody.

In other embodiments of the present invention, the invention provides vectors comprising DNA encoding any of the herein described polypeptides. Host cell comprising any such vector are also provided. By way of example, the host cells may be CHO cells, E. coli, or yeast. A process for producing any of the herein described polypeptides is further provided and comprises culturing host cells under conditions suitable for expression of the desired polypeptide and recovering the desired polypeptide from the cell culture.

In other embodiments, the invention provides chimeric molecules comprising any of the herein described polypeptides fused to a heterologous polypeptide or amino acid sequence. Example of such chimeric molecules comprise any of the herein described polypeptides fused to an epitope tag sequence or a Fc region of an immunoglobulin.

In another embodiment, the invention provides an antibody which binds, preferably specifically, to any of the above or below described polypeptides. Optionally, the antibody is a monoclonal antibody, humanized antibody, antibody fragment or single-chain antibody.

In yet other embodiments, the invention provides oligonucleotide probes which may be useful for isolating genomic and cDNA nucleotide sequences, measuring or detecting expression of an associated gene or as antisense probes, wherein those probes may be derived from any of the above or below described nucleotide sequences. Preferred probe lengths are described above.

In yet other embodiments, the present invention is directed to methods of using the PRO polypeptides of the present invention for a variety of uses based upon the functional biological assay data presented in the Examples below.

BRIEF DESCRIPTION OF THE DRAWINGS

FIGS. 1A-1B show a nucleotide sequence (SEQ ID NO:1) of a native sequence PRO6004 cDNA, wherein SEQ ID NO:1 is a clone designated herein as "DNA92259".

FIG. 2 shows the amino acid sequence (SEQ ID NO:2) derived from the coding sequence of SEQ ID NO:1 shown in FIGS. 1A-1B.

FIG. 3 shows a nucleotide sequence (SEQ ID NO:3) of a native sequence PRO4981 cDNA, wherein SEQ ID NO:3 is a clone designated herein as "DNA94849-2960".

FIG. 4 shows the amino acid sequence (SEQ ID NO:4) derived from the coding sequence of SEQ ID NO:3 shown in FIG. 3.

FIG. 5 shows a nucleotide sequence (SEQ ID NO:5) of a native sequence PRO7174 cDNA, wherein SEQ ID NO:5 is a clone designated herein as "DNA96883-2745".

FIG. 6 shows the amino acid sequence (SEQ ID NO:6) derived from the coding sequence of SEQ ID NO:5 shown in FIG. 5.

FIG. 7 shows a nucleotide sequence (SEQ ID NO:7) of a native sequence PRO5778 cDNA, wherein SEQ ID NO:7 is a clone designated herein as "DNA96894-2675".

FIG. 8 shows the amino acid sequence (SEQ ID NO:8) derived from the coding sequence of SEQ ID NO:7 shown in FIG. 7.

FIG. 9 shows a nucleotide sequence (SEQ ID NO:9) of a native sequence PRO4332 cDNA, wherein SEQ ID NO:9 is a clone designated herein as "DNA100272-2969".

FIG. 10 shows the amino acid sequence (SEQ ID NO:10) derived from the coding sequence of SEQ ID NO:9 shown in FIG. 9.

FIG. 11 shows a nucleotide sequence (SEQ ID NO:11) of a native sequence PRO9799 cDNA, wherein SEQ ID NO:11 is a clone designated herein as "DNA108696-2966".

FIG. 12 shows the amino acid sequence (SEQ ID NO:12) derived from the coding sequence of SEQ ID NO:11 shown in FIG. 11.

FIG. 13 shows a nucleotide sequence (SEQ ID NO:13) of a native sequence PRO9909 cDNA, wherein SEQ ID NO:13 is a clone designated herein as "DNA117935-2801".

FIG. 14 shows the amino acid sequence (SEQ ID NO:14) derived from the coding sequence of SEQ ID NO:13 shown in FIG. 13.

FIG. 15 shows a nucleotide sequence (SEQ ID NO:15) of a native sequence PRO9917 cDNA, wherein SEQ ID NO:15 is a clone designated herein as "DNA119474-2803".

FIG. 16 shows the amino acid sequence (SEQ ID NO:16) derived from the coding sequence of SEQ ID NO:15 shown in FIG. 15.

FIG. 17 shows a nucleotide sequence (SEQ ID NO:17) of a native sequence PRO9771 cDNA, wherein SEQ ID NO:17 is a clone designated herein as "DNA119498-2965".

FIG. 18 shows the amino acid sequence (SEQ ID NO:18) derived from the coding sequence of SEQ ID NO:17 shown in FIG. 17.

FIG. 19 shows a nucleotide sequence (SEQ ID NO:19) of a native sequence PRO9877 cDNA, wherein SEQ ID NO:19 is a clone designated herein as "DNA119502-2789".

FIG. 20 shows the amino acid sequence (SEQ ID NO:20) derived from the coding sequence of SEQ ID NO:19 shown in FIG. 19.

FIG. 21 shows a nucleotide sequence (SEQ ID NO:21) of a native sequence PRO9903 cDNA, wherein SEQ ID NO:21 is a clone designated herein as "DNA119516-2797".

FIG. 22 shows the amino acid sequence (SEQ ID NO:22) derived from the coding sequence of SEQ ID NO:21 shown in FIG. 21.

FIG. 23 shows a nucleotide sequence (SEQ ID NO:23) of a native sequence PRO9830 cDNA, wherein SEQ ID NO:23 is a clone designated herein as "DNA119530-2968".

FIG. 24 shows the amino acid sequence (SEQ ID NO:24) derived from the coding sequence of SEQ ID NO:23 shown in FIG. 23.

FIG. 25 shows a nucleotide sequence (SEQ ID NO:25) of a native sequence PRO7155 cDNA, wherein SEQ ID NO:25 is a clone designated herein as "DNA121772-2741".

FIG. 26 shows the amino acid sequence (SEQ ID NO:26) derived from the coding sequence of SEQ ID NO:25 shown in FIG. 25.

FIG. 27 shows a nucleotide sequence (SEQ ID NO:27) of a native sequence PRO9862 cDNA, wherein SEQ ID NO:27 is a clone designated herein as "DNA125148-2782".

FIG. 28 shows the amino acid sequence (SEQ ID NO:28) derived from the coding sequence of SEQ ID NO:27 shown in FIG. 27.

FIG. 29 shows a nucleotide sequence (SEQ ID NO:29) of a native sequence PRO9882 cDNA, wherein SEQ ID NO:29 is a clone designated herein as "DNA125150-2793".

FIG. 30 shows the amino acid sequence (SEQ ID NO:30) derived from the coding sequence of SEQ ID NO:29 shown in FIG. 29.

FIG. 31 shows a nucleotide sequence (SEQ ID NO:31) of a native sequence PRO9864 cDNA, wherein SEQ ID NO:31 is a clone designated herein as "DNA125151-2784".

FIG. 32 shows the amino acid sequence (SEQ ID NO:32) derived from the coding sequence of SEQ ID NO:31 shown in FIG. 31.

FIG. 33 shows a nucleotide sequence (SEQ ID NO:33) of a native sequence PRO10013 cDNA, wherein SEQ ID NO:33 is a clone designated herein as "DNA125181-2804".

FIG. 34 shows the amino acid sequence (SEQ ID NO:34) derived from the coding sequence of SEQ ID NO:33 shown in FIG. 33.

FIG. 35 shows a nucleotide sequence (SEQ ID NO:35) of a native sequence PRO9885 cDNA, wherein SEQ ID NO:35 is a clone designated herein as "DNA125192-2794".

FIG. 36 shows the amino acid sequence (SEQ ID NO:36) derived from the coding sequence of SEQ ID NO:35 shown in FIG. 35.

FIG. 37 shows a nucleotide sequence (SEQ ID NO:37) of a native sequence PRO9879 cDNA, wherein SEQ ID NO:37 is a clone designated herein as "DNA125196-2792".

FIG. 38 shows the amino acid sequence (SEQ ID NO:38) derived from the coding sequence of SEQ ID NO:37 shown in FIG. 37.

FIG. 39 shows a nucleotide sequence (SEQ ID NO:39) of a native sequence PRO10111 cDNA, wherein SEQ ID NO:39 is a clone designated herein as "DNA125200-2810".

FIG. 40 shows the amino acid sequence (SEQ ID NO:40) derived from the coding sequence of SEQ ID NO:39 shown in FIG. 39.

FIG. 41 shows a nucleotide sequence (SEQ ID NO:41) of a native sequence PRO9925 cDNA, wherein SEQ ID NO:41 is a clone designated herein as "DNA125214-2814".

FIG. 42 shows the amino acid sequence (SEQ ID NO:42) derived from the coding sequence of SEQ ID NO:41 shown in FIG. 41.

FIG. 43 shows a nucleotide sequence (SEQ ID NO:43) of a native sequence PRO9905 cDNA, wherein SEQ ID NO:43 is a clone designated herein as "DNA125219-2799".

FIG. 44 shows the amino acid sequence (SEQ ID NO:44) derived from the coding sequence of SEQ ID NO:43 shown in FIG. 43.

FIG. 45 shows a nucleotide sequence (SEQ ID NO:45) of a native sequence PRO10276 cDNA, wherein SEQ ID NO:45 is a clone designated herein as "DNA128309-2825".

FIG. 46 shows the amino acid sequence (SEQ ID NO:46) derived from the coding sequence of SEQ ID NO:45 shown in FIG. 45.

FIG. 47 shows a nucleotide sequence (SEQ ID NO:47) of a native sequence PRO9898 cDNA, wherein SEQ ID NO:47 is a clone designated herein as "DNA129535-2796".

FIG. 48 shows the amino acid sequence (SEQ ID NO:48) derived from the coding sequence of SEQ ID NO:47 shown in FIG. 47.

FIG. 49 shows a nucleotide sequence (SEQ ID NO:49) of a native sequence PRO9904 cDNA, wherein SEQ ID NO:49 is a clone designated herein as "DNA129549-2798".

FIG. 50 shows the amino acid sequence (SEQ ID NO:50) derived from the coding sequence of SEQ ID NO:49 shown in FIG. 49.

FIG. 51 shows a nucleotide sequence (SEQ ID NO:51) of a native sequence PRO19632 cDNA, wherein SEQ ID NO:51 is a clone designated herein as "DNA129580-2863".

FIG. 52 shows the amino acid sequence (SEQ ID NO:52) derived from the coding sequence of SEQ ID NO:51 shown in FIG. 51.

FIG. 53 shows a nucleotide sequence (SEQ ID NO:53) of a native sequence PRO19672 cDNA, wherein SEQ ID NO:53 is a clone designated herein as "DNA129794-2967".

FIG. 54 shows the amino acid sequence (SEQ ID NO:54) derived from the coding sequence of SEQ ID NO:53 shown in FIG. 53.

FIG. 55 shows a nucleotide sequence (SEQ ID NO:55) of a native sequence PRO9783 cDNA, wherein SEQ ID NO:55 is a clone designated herein as "DNA131590-2962".

FIG. 56 shows the amino acid sequence (SEQ ID NO:56) derived from the coding sequence of SEQ ID NO:55 shown in FIG. 55.

FIG. 57 shows a nucleotide sequence (SEQ ID NO:57) of a native sequence PRO10112 cDNA, wherein SEQ ID NO:57 is a clone designated herein as "DNA135173-2811".

FIG. 58 shows the amino acid sequence (SEQ ID NO:58) derived from the coding sequence of SEQ ID NO:57 shown in FIG. 57.

FIGS. 59A-59B show a nucleotide sequence (SEQ ID NO:59) of a native sequence PRO10284 cDNA, wherein SEQ ID NO:59 is a clone designated herein as "DNA138039-2828".

FIG. 60 shows the amino acid sequence (SEQ ID NO:60) derived from the coding sequence of SEQ ID NO:59 shown in FIGS. 59A-59B.

FIG. 61 shows a nucleotide sequence (SEQ ID NO:61) of a native sequence PRO10100 cDNA, wherein SEQ ID NO:61 is a clone designated herein as "DNA139540-2807".

FIG. 62 shows the amino acid sequence (SEQ ID NO:62) derived from the coding sequence of SEQ ID NO:61 shown in FIG. 61.

FIG. 63 shows a nucleotide sequence (SEQ ID NO:63) of a native sequence PRO19628 cDNA, wherein SEQ ID NO:63 is a clone designated herein as "DNA139602-2859".

FIG. 64 shows the amino acid sequence (SEQ ID NO:64) derived from the coding sequence of SEQ ID NO:63 shown in FIG. 63.

FIG. 65 shows a nucleotide sequence (SEQ ID NO:65) of a native sequence PRO19684 cDNA, wherein SEQ ID NO:65 is a clone designated herein as "DNA139632-2880".

FIG. 66 shows the amino acid sequence (SEQ ID NO:66) derived from the coding sequence of SEQ ID NO:65 shown in FIG. 65.

FIG. 67 shows a nucleotide sequence (SEQ ID NO:67) of a native sequence PRO10274 cDNA, wherein SEQ ID NO:67 is a clone designated herein as "DNA139686-2823".

FIG. 68 shows the amino acid sequence (SEQ ID NO:68) derived from the coding sequence of SEQ ID NO:67 shown in FIG. 67.

FIG. 69 shows a nucleotide sequence (SEQ ID NO:69) of a native sequence PRO9907 cDNA, wherein SEQ ID NO:69 is a clone designated herein as "DNA142392-2800".

FIG. 70 shows the amino acid sequence (SEQ ID NO:70) derived from the coding sequence of SEQ ID NO:69 shown in FIG. 69.

FIG. 71 shows a nucleotide sequence (SEQ ID NO:71) of a native sequence PRO9873 cDNA, wherein SEQ ID NO:71 is a clone designated herein as "DNA143076-2787".

FIG. 72 shows the amino acid sequence (SEQ ID NO:72) derived from the coding sequence of SEQ ID NO:71 shown in FIG. 71.

FIG. 73 shows a nucleotide sequence (SEQ ID NO:73) of a native sequence PRO10201 cDNA, wherein SEQ ID NO:73 is a clone designated herein as "DNA143294-2818".

FIG. 74 shows the amino acid sequence (SEQ ID NO:74) derived from the coding sequence of SEQ ID NO:73 shown in FIG. 73.

FIG. 75 shows a nucleotide sequence (SEQ ID NO:75) of a native sequence PRO10200 cDNA, wherein SEQ ID NO:75 is a clone designated herein as "DNA143514-2817".

FIG. 76 shows the amino acid sequence (SEQ ID NO:76) derived from the coding sequence of SEQ ID NO:75 shown in FIG. 75.

FIG. 77 shows a nucleotide sequence (SEQ ID NO:77) of a native sequence PRO10196 cDNA, wherein SEQ ID NO:77 is a clone designated herein as "DNA144841-2816".

FIG. 78 shows the amino acid sequence (SEQ ID NO:78) derived from the coding sequence of SEQ ID NO:77 shown in FIG. 77.

FIG. 79 shows a nucleotide sequence (SEQ ID NO:79) of a native sequence PRO10282 cDNA, wherein SEQ ID NO:79 is a clone designated herein as "DNA148380-2827".

FIG. 80 shows the amino acid sequence (SEQ ID NO:80) derived from the coding sequence of SEQ ID NO:79 shown in FIG. 79.

FIG. 81 shows a nucleotide sequence (SEQ ID NO:81) of a native sequence PRO19650 cDNA, wherein SEQ ID NO:81 is a clone designated herein as "DNA149995-2871".

FIG. 82 shows the amino acid sequence (SEQ ID NO:82) derived from the coding sequence of SEQ ID NO:81 shown in FIG. 81.

FIG. 83 shows a nucleotide sequence (SEQ ID NO:83) of a native sequence PRO21184 cDNA, wherein SEQ ID NO:83 is a clone designated herein as "DNA167678-2963".

FIG. 84 shows the amino acid sequence (SEQ ID NO:84) derived from the coding sequence of SEQ ID NO:83 shown in FIG. 83.

FIG. 85 shows a nucleotide sequence (SEQ ID NO:85) of a native sequence PRO21201 cDNA, wherein SEQ ID NO:85 is a clone designated herein as "DNA168028-2956".

FIG. 86 shows the amino acid sequence (SEQ ID NO:86) derived from the coding sequence of SEQ ID NO:85 shown in FIG. 85.

FIG. 87 shows a nucleotide sequence (SEQ ID NO:87) of a native sequence PRO21175 cDNA, wherein SEQ ID NO:87 is a clone designated herein as "DNA173894-2947".

FIG. 88 shows the amino acid sequence (SEQ ID NO:88) derived from the coding sequence of SEQ ID NO:87 shown in FIG. 87.

FIG. 89 shows a nucleotide sequence (SEQ ID NO:89) of a native sequence PRO21340 cDNA, wherein SEQ ID NO:89 is a clone designated herein as "DNA176775-2957".

FIG. 90 shows the amino acid sequence (SEQ ID NO:90) derived from the coding sequence of SEQ ID NO:89 shown in FIG. 89.

FIG. 91 shows a nucleotide sequence (SEQ ID NO:91) of a native sequence PRO21384 cDNA, wherein SEQ ID NO:91 is a clone designated herein as "DNA177313-2982".

FIG. 92 shows the amino acid sequence (SEQ ID NO:92) derived from the coding sequence of SEQ ID NO:91 shown in FIG. 91.

FIG. 93 shows a nucleotide sequence (SEQ ID NO:93) of a native sequence PRO982 cDNA, wherein SEQ ID NO:93 is a clone designated herein as "DNA57700-1408".

FIG. 94 shows the amino acid sequence (SEQ ID NO:94) derived from the coding sequence of SEQ ID NO:93 shown in FIG. 93.

FIG. 95 shows a nucleotide sequence (SEQ ID NO:95) of a native sequence PRO1160 cDNA, wherein SEQ ID NO:95 is a clone designated herein as "DNA62872-1509".

FIG. 96 shows the amino acid sequence (SEQ ID NO:96) derived from the coding sequence of SEQ ID NO:95 shown in FIG. 95.

FIG. 97 shows a nucleotide sequence (SEQ ID NO:97) of a native sequence PRO1187 cDNA, wherein SEQ ID NO:97 is a clone designated herein as "DNA62876-1517".

FIG. 98 shows the amino acid sequence (SEQ ID NO:98) derived from the coding sequence of SEQ ID NO:97 shown in FIG. 97.

FIG. 99 shows a nucleotide sequence (SEQ ID NO:99) of a native sequence PRO1329 cDNA, wherein SEQ ID NO:99 is a clone designated herein as "DNA66660-1585".

FIG. 100 shows the amino acid sequence (SEQ ID NO:100) derived from the coding sequence of SEQ ID NO:99 shown in FIG. 99.

FIG. 101 shows a nucleotide sequence (SEQ ID NO:101) of a native sequence PRO231 cDNA, wherein SEQ ID NO:101 is a clone designated herein as "DNA34434-1139".

FIG. 102 shows the amino acid sequence (SEQ ID NO:102) derived from the coding sequence of SEQ ID NO:101 shown in FIG. 101.

FIG. 103 shows a nucleotide sequence (SEQ ID NO:103) of a native sequence PRO357 cDNA, wherein SEQ ID NO:103 is a clone designated herein as "DNA44804-1248".

FIG. 104 shows the amino acid sequence (SEQ ID NO:104) derived from the coding sequence of SEQ ID NO:103 shown in FIG. 103.

FIG. 105 shows a nucleotide sequence (SEQ ID NO:105) of a native sequence PRO725 cDNA, wherein SEQ ID NO:105 is a clone designated herein as "DNA52758-1399".

FIG. 106 shows the amino acid sequence (SEQ ID NO:106) derived from the coding sequence of SEQ ID NO:105 shown in FIG. 105.

FIG. 107 shows a nucleotide sequence (SEQ ID NO:107) of a native sequence PRO1155 cDNA, wherein SEQ ID NO:107 is a clone designated herein as "DNA59849-1504".

FIG. 108 shows the amino acid sequence (SEQ ID NO:108) derived from the coding sequence of SEQ ID NO:107 shown in FIG. 107.

FIG. 109 shows a nucleotide sequence (SEQ ID NO:109) of a native sequence PRO1306 cDNA, wherein SEQ ID NO:109 is a clone designated herein as "DNA65410-1569".

FIG. 110 shows the amino acid sequence (SEQ ID NO:110) derived from the coding sequence of SEQ ID NO:109 shown in FIG. 109.

FIG. 111 shows a nucleotide sequence (SEQ ID NO:111) of a native sequence PRO1419 cDNA, wherein SEQ ID NO:111 is a clone designated herein as "DNA71290-1630".

FIG. 112 shows the amino acid sequence (SEQ ID NO:112) derived from the coding sequence of SEQ ID NO:111 shown in FIG. 111.

FIG. 113 shows a nucleotide sequence (SEQ ID NO:113) of a native sequence PRO229 cDNA, wherein SEQ ID NO:113 is a clone designated herein as "DNA33100-1159".

FIG. 114 shows the amino acid sequence (SEQ ID NO:114) derived from the coding sequence of SEQ ID NO:113 shown in FIG. 113.

FIG. 115 shows a nucleotide sequence (SEQ ID NO:115) of a native sequence PRO1272 cDNA, wherein SEQ ID NO:115 is a clone designated herein as "DNA64896-1539".

FIG. 116 shows the amino acid sequence (SEQ ID NO:116) derived from the coding sequence of SEQ ID NO:115 shown in FIG. 115.

FIG. 117 shows a nucleotide sequence (SEQ ID NO:117) of a native sequence PRO4405 cDNA, wherein SEQ ID NO:117 is a clone designated herein as "DNA84920-2614".

FIG. 118 shows the amino acid sequence (SEQ ID NO:118) derived from the coding sequence of SEQ ID NO:117 shown in FIG. 117.

FIG. 119 shows a nucleotide sequence (SEQ ID NO:119) of a native sequence PRO181 cDNA, wherein SEQ ID NO:119 is a clone designated herein as "DNA23330-1390".

FIG. 120 shows the amino acid sequence (SEQ ID NO:120) derived from the coding sequence of SEQ ID NO:119 shown in FIG. 119.

FIG. 121 shows a nucleotide sequence (SEQ ID NO:121) of a native sequence PRO214 cDNA, wherein SEQ ID NO:121 is a clone designated herein as "DNA32286-1191".

FIG. 122 shows the amino acid sequence (SEQ ID NO:122) derived from the coding sequence of SEQ ID NO:121 shown in FIG. 121.

FIG. 123 shows a nucleotide sequence (SEQ ID NO:123) of a native sequence PRO247 cDNA, wherein SEQ ID NO:123 is a clone designated herein as "DNA35673-1201".

FIG. 124 shows the amino acid sequence (SEQ ID NO:124) derived from the coding sequence of SEQ ID NO:123 shown in FIG. 123.

FIG. 125 shows a nucleotide sequence (SEQ ID NO:125) of a native sequence PRO337 cDNA, wherein SEQ ID NO:125 is a clone designated herein as "DNA43316-1237".

FIG. 126 shows the amino acid sequence (SEQ ID NO:126) derived from the coding sequence of SEQ ID NO:125 shown in FIG. 125.

FIG. 127 shows a nucleotide sequence (SEQ ID NO:127) of a native sequence PRO526 cDNA, wherein SEQ ID NO:127 is a clone designated herein as "DNA44184-1319".

FIG. 128 shows the amino acid sequence (SEQ ID NO:128) derived from the coding sequence of SEQ ID NO:127 shown in FIG. 127.

FIG. 129 shows a nucleotide sequence (SEQ ID NO:129) of a native sequence PRO363 cDNA, wherein SEQ ID NO:129 is a clone designated herein as "DNA45419-1252".

FIG. 130 shows the amino acid sequence (SEQ ID NO:130) derived from the coding sequence of SEQ ID NO:129 shown in FIG. 129.

FIG. 131 shows a nucleotide sequence (SEQ ID NO:131) of a native sequence PRO531 cDNA, wherein SEQ ID NO:131 is a clone designated herein as "DNA48314-1320".

FIG. 132 shows the amino acid sequence (SEQ ID NO:132) derived from the coding sequence of SEQ ID NO:131 shown in FIG. 131.

FIG. 133 shows a nucleotide sequence (SEQ ID NO:133) of a native sequence PRO1083 cDNA, wherein SEQ ID NO:133 is a clone designated herein as "DNA50921-1458".

FIG. 134 shows the amino acid sequence (SEQ ID NO:134) derived from the coding sequence of SEQ ID NO:133 shown in FIG. 133.

FIG. 135 shows a nucleotide sequence (SEQ ID NO:135) of a native sequence PRO840 cDNA, wherein SEQ ID NO:135 is a clone designated herein as "DNA53987".

FIG. 136 shows the amino acid sequence (SEQ ID NO:136) derived from the coding sequence of SEQ ID NO:135 shown in FIG. 135.

FIG. 137 shows a nucleotide sequence (SEQ ID NO:137) of a native sequence PRO1080 cDNA, wherein SEQ ID NO:137 is a clone designated herein as "DNA56047-1456".

FIG. 138 shows the amino acid sequence (SEQ ID NO:138) derived from the coding sequence of SEQ ID NO:137 shown in FIG. 137.

FIG. 139 shows a nucleotide sequence (SEQ ID NO:139) of a native sequence PRO788 cDNA, wherein SEQ ID NO:139 is a clone designated herein as "DNA56405-1357".

FIG. 140 shows the amino acid sequence (SEQ ID NO:140) derived from the coding sequence of SEQ ID NO:139 shown in FIG. 139.

FIG. 141 shows a nucleotide sequence (SEQ ID NO:141) of a native sequence PRO1478 cDNA, wherein SEQ ID NO:141 is a clone designated herein as "DNA56531-1648".

FIG. 142 shows the amino acid sequence (SEQ ID NO:142) derived from the coding sequence of SEQ ID NO:141 shown in FIG. 141.

FIG. 143 shows a nucleotide sequence (SEQ ID NO:143) of a native sequence PRO1134 cDNA, wherein SEQ ID NO:143 is a clone designated herein as "DNA56865-1491".

FIG. 144 shows the amino acid sequence (SEQ ID NO:144) derived from the coding sequence of SEQ ID NO:143 shown in FIG. 143.

FIG. 145 shows a nucleotide sequence (SEQ ID NO:145) of a native sequence PRO826 cDNA, wherein SEQ ID NO:145 is a clone designated herein as "DNA57694-1341".

FIG. 146 shows the amino acid sequence (SEQ ID NO:146) derived from the coding sequence of SEQ ID NO:145 shown in FIG. 145.

FIG. 147 shows a nucleotide sequence (SEQ ID NO:147) of a native sequence PRO1005 cDNA, wherein SEQ ID NO:147 is a clone designated herein as "DNA57708-1411".

FIG. 148 shows the amino acid sequence (SEQ ID NO:148) derived from the coding sequence of SEQ ID NO:147 shown in FIG. 147.

FIG. 149 shows a nucleotide sequence (SEQ ID NO:149) of a native sequence PRO809 cDNA, wherein SEQ ID NO:149 is a clone designated herein as "DNA57836-1338".

FIG. 150 shows the amino acid sequence (SEQ ID NO:150) derived from the coding sequence of SEQ ID NO:149 shown in FIG. 149.

FIG. 151 shows a nucleotide sequence (SEQ ID NO:151) of a native sequence PRO1194 cDNA, wherein SEQ ID NO:151 is a clone designated herein as "DNA57841-1522".

FIG. 152 shows the amino acid sequence (SEQ ID NO:152) derived from the coding sequence of SEQ ID NO:151 shown in FIG. 151.

FIG. 153 shows a nucleotide sequence (SEQ ID NO:153) of a native sequence PRO1071 cDNA, wherein SEQ ID NO:153 is a clone designated herein as "DNA58847-1383".

FIG. 154 shows the amino acid sequence (SEQ ID NO:154) derived from the coding sequence of SEQ ID NO:153 shown in FIG. 153.

FIG. 155 shows a nucleotide sequence (SEQ ID NO:155) of a native sequence PRO1411 cDNA, wherein SEQ ID NO:155 is a clone designated herein as "DNA59212-1627".

FIG. 156 shows the amino acid sequence (SEQ ID NO:156) derived from the coding sequence of SEQ ID NO:155 shown in FIG. 155.

FIG. 157 shows a nucleotide sequence (SEQ ID NO:157) of a native sequence PRO1309 cDNA, wherein SEQ ID NO:157 is a clone designated herein as "DNA59588-1571".

FIG. 158 shows the amino acid sequence (SEQ ID NO:158) derived from the coding sequence of SEQ ID NO:157 shown in FIG. 157.

FIG. 159 shows a nucleotide sequence (SEQ ID NO:159) of a native sequence PRO1025 cDNA, wherein SEQ ID NO:159 is a clone designated herein as "DNA59622-1334".

FIG. 160 shows the amino acid sequence (SEQ ID NO:160) derived from the coding sequence of SEQ ID NO:159 shown in FIG. 159.

FIG. 161 shows a nucleotide sequence (SEQ ID NO:161) of a native sequence PRO1181 cDNA, wherein SEQ ID NO:161 is a clone designated herein as "DNA59847-2510".

FIG. 162 shows the amino acid sequence (SEQ ID NO:162) derived from the coding sequence of SEQ ID NO:161 shown in FIG. 161.

FIG. 163 shows a nucleotide sequence (SEQ ID NO:163) of a native sequence PRO1126 cDNA, wherein SEQ ID NO:163 is a clone designated herein as "DNA60615-1483".

FIG. 164 shows the amino acid sequence (SEQ ID NO:164) derived from the coding sequence of SEQ ID NO:163 shown in FIG. 163.

FIG. 165 shows a nucleotide sequence (SEQ ID NO:165) of a native sequence PRO1186 cDNA, wherein SEQ ID NO:165 is a clone designated herein as "DNA60621-1516".

FIG. 166 shows the amino acid sequence (SEQ ID NO:166) derived from the coding sequence of SEQ ID NO:165 shown in FIG. 165.

FIG. 167 shows a nucleotide sequence (SEQ ID NO:167) of a native sequence PRO1192 cDNA, wherein SEQ ID NO:167 is a clone designated herein as "DNA62814-1521".

FIG. 168 shows the amino acid sequence (SEQ ID NO:168) derived from the coding sequence of SEQ ID NO:167 shown in FIG. 167.

FIG. 169 shows a nucleotide sequence (SEQ ID NO:169) of a native sequence PRO1244 cDNA, wherein SEQ ID NO:169 is a clone designated herein as "DNA64883-1526".

FIG. 170 shows the amino acid sequence (SEQ ID NO:170) derived from the coding sequence of SEQ ID NO:169 shown in FIG. 169.

FIG. 171 shows a nucleotide sequence (SEQ ID NO:171) of a native sequence PRO1274 cDNA, wherein SEQ ID NO:171 is a clone designated herein as "DNA64889-1541".

FIG. 172 shows the amino acid sequence (SEQ ID NO:172) derived from the coding sequence of SEQ ID NO:171 shown in FIG. 171.

FIG. 173 shows a nucleotide sequence (SEQ ID NO:173) of a native sequence PRO1412 cDNA, wherein SEQ ID NO:173 is a clone designated herein as "DNA64897-1628".

FIG. 174 shows the amino acid sequence (SEQ ID NO:174) derived from the coding sequence of SEQ ID NO:173 shown in FIG. 173.

FIG. 175 shows a nucleotide sequence (SEQ ID NO:175) of a native sequence PRO1286 cDNA, wherein SEQ ID NO:175 is a clone designated herein as "DNA64903-1553".

FIG. 176 shows the amino acid sequence (SEQ ID NO:176) derived from the coding sequence of SEQ ID NO:175 shown in FIG. 175.

FIG. 177 shows a nucleotide sequence (SEQ ID NO:177) of a native sequence PRO1330 cDNA, wherein SEQ ID NO:177 is a clone designated herein as "DNA64907-1163-1".

FIG. 178 shows the amino acid sequence (SEQ ID NO:178) derived from the coding sequence of SEQ ID NO:177 shown in FIG. 177.

FIG. 179 shows a nucleotide sequence (SEQ ID NO:179) of a native sequence PRO1347 cDNA, wherein SEQ ID NO:179 is a clone designated herein as "DNA64950-1590".

FIG. 180 shows the amino acid sequence (SEQ ID NO:180) derived from the coding sequence of SEQ ID NO:179 shown in FIG. 179.

FIG. 181 shows a nucleotide sequence (SEQ ID NO:181) of a native sequence PRO1305 cDNA, wherein SEQ ID NO:181 is a clone designated herein as "DNA64952-1568".

FIG. 182 shows the amino acid sequence (SEQ ID NO:182) derived from the coding sequence of SEQ ID NO:181 shown in FIG. 181.

FIG. 183 shows a nucleotide sequence (SEQ ID NO:183) of a native sequence PRO1273 cDNA, wherein SEQ ID NO:183 is a clone designated herein as "DNA65402-1540".

FIG. 184 shows the amino acid sequence (SEQ ID NO:184) derived from the coding sequence of SEQ ID NO:183 shown in FIG. 183.

FIG. 185 shows a nucleotide sequence (SEQ ID NO:185) of a native sequence PRO1279 cDNA, wherein SEQ ID NO:185 is a clone designated herein as "DNA65405-1547".

FIG. 186 shows the amino acid sequence (SEQ ID NO:186) derived from the coding sequence of SEQ ID NO:185 shown in FIG. 185.

FIG. 187 shows a nucleotide sequence (SEQ ID NO:187) of a native sequence PRO1340 cDNA, wherein SEQ ID NO:187 is a clone designated herein as "DNA66663-1598".

FIG. 188 shows the amino acid sequence (SEQ ID NO:188) derived from the coding sequence of SEQ ID NO:187 shown in FIG. 187.

FIG. 189 shows a nucleotide sequence (SEQ ID NO:189) of a native sequence PRO1338 cDNA, wherein SEQ ID NO:189 is a clone designated herein as "DNA66667".

FIG. 190 shows the amino acid sequence (SEQ ID NO:190) derived from the coding sequence of SEQ ID NO:189 shown in FIG. 189.

FIG. 191 shows a nucleotide sequence (SEQ ID NO:191) of a native sequence PRO1343 cDNA, wherein SEQ ID NO:191 is a clone designated herein as "DNA66675-1587".

FIG. 192 shows the amino acid sequence (SEQ ID NO:192) derived from the coding sequence of SEQ ID NO:191 shown in FIG. 191.

FIG. 193 shows a nucleotide sequence (SEQ ID NO:193) of a native sequence PRO1376 cDNA, wherein SEQ ID NO:193 is a clone designated herein as "DNA67300-1605".

FIG. 194 shows the amino acid sequence (SEQ ID NO:194) derived from the coding sequence of SEQ ID NO:193 shown in FIG. 193.

FIG. 195 shows a nucleotide sequence (SEQ ID NO:195) of a native sequence PRO1387 cDNA, wherein SEQ ID NO:195 is a clone designated herein as "DNA68872-1620".

FIG. 196 shows the amino acid sequence (SEQ ID NO:196) derived from the coding sequence of SEQ ID NO:195 shown in FIG. 195.

FIG. 197 shows a nucleotide sequence (SEQ ID NO:197) of a native sequence PRO1409 cDNA, wherein SEQ ID NO:197 is a clone designated herein as "DNA71269-1621".

FIG. 198 shows the amino acid sequence (SEQ ID NO:198) derived from the coding sequence of SEQ ID NO:197 shown in FIG. 197.

FIG. 199 shows a nucleotide sequence (SEQ ID NO:199) of a native sequence PRO1488 cDNA, wherein SEQ ID NO:199 is a clone designated herein as "DNA73736-1657".

FIG. 200 shows the amino acid sequence (SEQ ID NO:200) derived from the coding sequence of SEQ ID NO:199 shown in FIG. 199.

FIG. 201 shows a nucleotide sequence (SEQ ID NO:201) of a native sequence PRO1474 cDNA, wherein SEQ ID NO:201 is a clone designated herein as "DNA73739-1645".

FIG. 202 shows the amino acid sequence (SEQ ID NO:202) derived from the coding sequence of SEQ ID NO:201 shown in FIG. 201.

FIG. 203 shows a nucleotide sequence (SEQ ID NO:203) of a native sequence PRO1917 cDNA, wherein SEQ ID NO:203 is a clone designated herein as "DNA76400-2528".

FIG. 204 shows the amino acid sequence (SEQ ID NO:204) derived from the coding sequence of SEQ ID NO:203 shown in FIG. 203.

FIG. 205 shows a nucleotide sequence (SEQ ID NO:205) of a native sequence PRO1760 cDNA, wherein SEQ ID NO:205 is a clone designated herein as "DNA76532-1702".

FIG. 206 shows the amino acid sequence (SEQ ID NO:206) derived from the coding sequence of SEQ ID NO:205 shown in FIG. 205.

FIG. 207 shows a nucleotide sequence (SEQ ID NO:207) of a native sequence PRO1567 cDNA, wherein SEQ ID NO:207 is a clone designated herein as "DNA76541-1675".

FIG. 208 shows the amino acid sequence (SEQ ID NO:208) derived from the coding sequence of SEQ ID NO:207 shown in FIG. 207.

FIG. 209 shows a nucleotide sequence (SEQ ID NO:209) of a native sequence PRO1887 cDNA, wherein SEQ ID NO:209 is a clone designated herein as "DNA79862-2522".

FIG. 210 shows the amino acid sequence (SEQ ID NO:210) derived from the coding sequence of SEQ ID NO:209 shown in FIG. 209.

FIG. 211 shows a nucleotide sequence (SEQ ID NO:211) of a native sequence PRO1928 cDNA, wherein SEQ ID NO:211 is a clone designated herein as "DNA81754-2532".

FIG. 212 shows the amino acid sequence (SEQ ID NO:212) derived from the coding sequence of SEQ ID NO:211 shown in FIG. 211.

FIG. 213 shows a nucleotide sequence (SEQ ID NO:213) of a native sequence PRO4341 cDNA, wherein SEQ ID NO:213 is a clone designated herein as "DNA81761-2583".

FIG. 214 shows the amino acid sequence (SEQ ID NO:214) derived from the coding sequence of SEQ ID NO:213 shown in FIG. 213.

FIG. 215 shows a nucleotide sequence (SEQ ID NO:215) of a native sequence PRO5723 cDNA, wherein SEQ ID NO:215 is a clone designated herein as "DNA82361".

FIG. 216 shows the amino acid sequence (SEQ ID NO:216) derived from the coding sequence of SEQ ID NO:215 shown in FIG. 215.

FIG. 217 shows a nucleotide sequence (SEQ ID NO:217) of a native sequence PRO1801 cDNA, wherein SEQ ID NO:217 is a clone designated herein as "DNA83500-2506".

FIG. 218 shows the amino acid sequence (SEQ ID NO:218) derived from the coding sequence of SEQ ID NO:217 shown in FIG. 217.

FIG. 219 shows a nucleotide sequence (SEQ ID NO:219) of a native sequence PRO4333 cDNA, wherein SEQ ID NO:219 is a clone designated herein as "DNA84210-2576".

FIG. 220 shows the amino acid sequence (SEQ ID NO:220) derived from the coding sequence of SEQ ID NO:219 shown in FIG. 219.

FIG. 221 shows a nucleotide sequence (SEQ ID NO:221) of a native sequence PRO3543 cDNA, wherein SEQ ID NO:221 is a clone designated herein as "DNA86571-2551".

FIG. 222 shows the amino acid sequence (SEQ ID NO:222) derived from the coding sequence of SEQ ID NO:221 shown in FIG. 221.

FIG. 223 shows a nucleotide sequence (SEQ ID NO:223) of a native sequence PRO3444 cDNA, wherein SEQ ID NO:223 is a clone designated herein as "DNA87997".

FIG. 224 shows the amino acid sequence (SEQ ID NO:224) derived from the coding sequence of SEQ ID NO:223 shown in FIG. 223.

FIG. 225 shows a nucleotide sequence (SEQ ID NO:225) of a native sequence PRO4302 cDNA, wherein SEQ ID NO:225 is a clone designated herein as "DNA92218-2554".

FIG. 226 shows the amino acid sequence (SEQ ID NO:226) derived from the coding sequence of SEQ ID NO:225 shown in FIG. 225.

FIG. 227 shows a nucleotide sequence (SEQ ID NO:227) of a native sequence PRO4322 cDNA, wherein SEQ ID NO:227 is a clone designated herein as "DNA92223-2567".

FIG. 228 shows the amino acid sequence (SEQ ID NO:228) derived from the coding sequence of SEQ ID NO:227 shown in FIG. 227.

FIG. 229 shows a nucleotide sequence (SEQ ID NO:229) of a native sequence PRO5725 cDNA, wherein SEQ ID NO:229 is a clone designated herein as "DNA92265-2669".

FIG. 230 shows the amino acid sequence (SEQ ID NO:230) derived from the coding sequence of SEQ ID NO:229 shown in FIG. 229.

FIG. 231 shows a nucleotide sequence (SEQ ID NO:231) of a native sequence PRO4408 cDNA, wherein SEQ ID NO:231 is a clone designated herein as "DNA92274-2617".

FIG. 232 shows the amino acid sequence (SEQ ID NO:232) derived from the coding sequence of SEQ ID NO:231 shown in FIG. 231.

FIG. 233 shows a nucleotide sequence (SEQ ID NO:233) of a native sequence PRO9940 cDNA, wherein SEQ ID NO:223 is a clone designated herein as "DNA92282".

FIG. 234 shows the amino acid sequence (SEQ ID NO:234) derived from the coding sequence of SEQ ID NO:233 shown in FIG. 233.

FIG. 235 shows a nucleotide sequence (SEQ ID NO:235) of a native sequence PRO7154 cDNA, wherein SEQ ID NO:235 is a clone designated herein as "DNA108760-2740".

FIG. 236 shows the amino acid sequence (SEQ ID NO:236) derived from the coding sequence of SEQ ID NO:235 shown in FIG. 235.

FIG. 237 shows a nucleotide sequence (SEQ ID NO:237) of a native sequence PRO7425 cDNA, wherein SEQ ID NO:237 is a clone designated herein as "DNA108792-2753".

FIG. 238 shows the amino acid sequence (SEQ ID NO:238) derived from the coding sequence of SEQ ID NO:237 shown in FIG. 237.

FIG. 239 shows a nucleotide sequence (SEQ ID NO:239) of a native sequence PRO6079 cDNA, wherein SEQ ID NO:239 is a clone designated herein as "DNA11750-2706".

FIG. 240 shows the amino acid sequence (SEQ ID NO:240) derived from the coding sequence of SEQ ID NO:239 shown in FIG. 239.

FIG. 241 shows a nucleotide sequence (SEQ ID NO:241) of a native sequence PRO9836 cDNA, wherein SEQ ID NO:241 is a clone designated herein as "DNA119514-2772".

FIG. 242 shows the amino acid sequence (SEQ ID NO:242) derived from the coding sequence of SEQ ID NO:241 shown in FIG. 241.

FIG. 243 shows a nucleotide sequence (SEQ ID NO:243) of a native sequence PRO10096 cDNA, wherein SEQ ID NO:243 is a clone designated herein as "DNA125185-2806".

FIG. 244 shows the amino acid sequence (SEQ ID NO:244) derived from the coding sequence of SEQ ID NO:243 shown in FIG. 243.

DETAILED DESCRIPTION OF THE PREFERRED EMBODIMENTS

I. Definitions

The terms "PRO polypeptide" and "PRO" as used herein and when immediately followed by a numerical designation refer to various polypeptides, wherein the complete designation (i.e., PRO/number) refers to specific polypeptide sequences as described herein. The terms "PRO/number polypeptide" and "PRO/number" wherein the term "number" is provided as an actual numerical designation as used herein encompass native sequence polypeptides and polypeptide variants (which are further defined herein). The PRO polypeptides described herein may be isolated from a variety of sources, such as from human tissue types or from another source, or prepared by recombinant or synthetic methods. The term "PRO polypeptide" refers to each individual PRO/number polypeptide disclosed herein. All disclosures in this specification which refer to the "PRO polypeptide" refer to each of the polypeptides individually as well as jointly. For example, descriptions of the preparation of, purification of, derivation of, formation of antibodies to or against, administration of, compositions containing, treatment of a disease with, etc., pertain to each polypeptide of the invention individually. The term "PRO polypeptide" also includes variants of the PRO/number polypeptides disclosed herein.

A "native sequence PRO polypeptide" comprises a polypeptide having the same amino acid sequence as the corresponding PRO polypeptide derived from nature. Such native sequence PRO polypeptides can be isolated from nature or can be produced by recombinant or synthetic means. The term "native sequence PRO polypeptide" specifically encompasses naturally-occurring truncated or secreted forms of the specific PRO polypeptide (e.g., an extracellular domain sequence), naturally-occurring variant forms (e.g., alternatively spliced forms) and naturally-occurring allelic variants of the polypeptide. In various embodiments of the invention, the native sequence PRO polypeptides disclosed herein are mature or full-length native sequence polypeptides comprising the full-length amino acids sequences shown in the accompanying figures. Start and stop codons are shown in bold font and underlined in the figures. However, while the PRO polypeptide disclosed in the accompanying figures are shown to begin with methionine residues designated herein as amino acid position 1 in the figures, it is conceivable and possible that other methionine residues located either upstream or downstream from the amino acid position 1 in the figures may be employed as the starting amino acid residue for the PRO polypeptides.

The PRO polypeptide "extracellular domain" or "ECD" refers to a form of the PRO polypeptide which is essentially free of the transmembrane and cytoplasmic domains. Ordinarily, a PRO polypeptide ECD will have less than 1% of such transmembrane and/or cytoplasmic domains and preferably, will have less than 0.5% of such domains. It will be understood that any transmembrane domains identified for the PRO polypeptides of the present invention are identified pursuant to criteria routinely employed in the art for identifying that type of hydrophobic domain. The exact boundaries of a transmembrane domain may vary but most likely by no more than about 5 amino acids at either end of the domain as initially identified herein. Optionally, therefore, an extracellular domain of a PRO polypeptide may contain from about 5 or fewer amino acids on either side of the transmembrane domain/extracellular domain boundary as identified in the Examples or specification and such polypeptides, with or without the associated signal peptide, and nucleic acid encoding them, are comtemplated by the present invention.

The approximate location of the "signal peptides" of the various PRO polypeptides disclosed herein are shown in the present specification and/or the accompanying figures. It is noted, however, that the C-terminal boundary of a signal peptide may vary, but most likely by no more than about 5 amino acids on either side of the signal peptide C-terminal boundary as initially identified herein, wherein the C-terminal boundary of the signal peptide may be identified pursuant to criteria routinely employed in the art for identifying that type of amino acid sequence element (e.g., Nielsen et al., *Prot. Eng.* 10:1-6 (1997) and von Heinje et al., *Nucl. Acids. Res.* 14:4683-4690 (1986)). Moreover, it is also recognized that, in some cases, cleavage of a signal sequence from a secreted polypeptide is not entirely uniform, resulting in more than one secreted species. These mature polypeptides, where the signal peptide is cleaved within no more than about 5 amino acids on either side of the C-terminal boundary of the signal peptide as identified herein, and the polynucleotides encoding them, are contemplated by the present invention.

"PRO polypeptide variant" means an active PRO polypeptide as defined above or below having at least about 80% amino acid sequence identity with a full-length native sequence PRO polypeptide sequence as disclosed herein, a PRO polypeptide sequence lacking the signal peptide as disclosed herein, an extracellular domain of a PRO polypeptide, with or without the signal peptide, as disclosed herein or any other fragment of a full-length PRO polypeptide sequence as disclosed herein. Such PRO polypeptide variants include, for instance, PRO polypeptides wherein one or more amino acid residues are added, or deleted, at the N- or C-terminus of the full-length native amino acid sequence. Ordinarily, a PRO polypeptide variant will have at least about 80% amino acid sequence identity, alternatively at least about 81% amino acid sequence identity, alternatively at least about 82% amino acid sequence identity, alternatively at least about 83% amino acid sequence identity, alternatively at least about 84% amino acid sequence identity, alternatively at least about 85% amino acid sequence identity, alternatively at least about 86% amino acid sequence identity, alternatively at least about 87% amino acid sequence identity, alternatively at least about 88% amino acid sequence identity, alternatively at least about 89% amino acid sequence identity, alternatively at least about 90% amino acid sequence identity, alternatively at least about 91% amino acid sequence identity, alternatively at least about 92% amino acid sequence identity, alternatively at least about 93% amino acid sequence identity, alternatively at least about 94% amino acid sequence identity, alternatively at least about 95% amino acid sequence identity, alternatively at least about 96% amino acid sequence identity, alternatively at least about 97% amino acid sequence identity, alternatively at least about 98% amino acid sequence identity and alternatively at least about 99% amino acid sequence identity to a full-length native sequence PRO polypeptide sequence as disclosed herein, a PRO polypeptide sequence lacking the signal peptide as disclosed herein, an extracellular domain of a PRO polypeptide, with or without the signal peptide, as disclosed herein or any other specifically defined fragment of a full-length PRO polypeptide sequence as disclosed herein. Ordinarily, PRO variant polypeptides are at least about 10 amino acids in length, alternatively at least about 20 amino acids in length, alternatively at least about 30 amino acids in length, alternatively at least about 40 amino acids in length, alternatively at least about 50 amino acids in length, alternatively at least about 60 amino acids in length, alternatively at least about 70 amino acids in length, alternatively at least about 80 amino acids in length, alternatively at least about 90 amino acids in length, alternatively at least about 100 amino acids in length, alternatively at least about 150 amino acids in length, alternatively at least about 200 amino acids in length, alternatively at least about 300 amino acids in length, or more.

"Percent (%) amino acid sequence identity" with respect to the PRO polypeptide sequences identified herein is defined as the percentage of amino acid residues in a candidate sequence that are identical with the amino acid residues in the specific PRO polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. For purposes herein, however, % amino acid sequence identity values are generated using the sequence comparison computer program ALIGN-2, wherein the complete source code for the ALIGN-2 program is provided in Table 1 below. The ALIGN-2 sequence comparison computer program was authored by Genentech, Inc. and the source code shown in Table 1 below has been filed with user documentation in the U.S. Copyright Office, Washington D.C., 20559, where it is registered under U.S. Copyright Registration No. TXU510087. The ALIGN-2 program is publicly available through Genentech, Inc., South San Francisco, Calif. or may be compiled from the source code provided in Table 1 below. The ALIGN-2 program should be compiled for use on a UNIX operating system, preferably digital UNIX V4.0D. All sequence comparison parameters are set by the ALIGN-2 program and do not vary.

In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction X/Y where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. As examples of % amino acid sequence identity calculations using this method, Tables 2 and 3 demonstrate how to calculate the % amino acid sequence identity of the amino acid sequence designated "Comparison Protein" to the amino acid sequence designated "PRO", wherein "PRO" represents the amino acid sequence of a hypothetical PRO polypeptide of interest, "Comparison Protein" represents the amino acid sequence of a polypeptide against which the "PRO" polypeptide of interest is being compared, and "X," "Y" and "Z" each represent different hypothetical amino acid residues.

Unless specifically stated otherwise, all % amino acid sequence identity values used herein are obtained as described in the immediately preceding paragraph using the ALIGN-2 computer program. However, % amino acid sequence identity values may also be obtained as described below by using the WU-BLAST-2 computer program (Altschul et al., *Methods in Enzymology* 266:460-480 (1996)). Most of the WU-BLAST-2 search parameters are set to the default values. Those not set to default values, i.e., the adjustable parameters, are set with the following values: overlap span=1, overlap fraction=0.125, word threshold (T)=11, and scoring matrix=BLOSUM62. When WU-BLAST-2 is employed, a % amino acid sequence identity value is determined by dividing (a) the number of matching identical amino acid residues between the amino acid sequence of the PRO polypeptide of interest having a sequence derived from the native PRO polypeptide and the comparison amino acid sequence of interest (i.e., the sequence against which the PRO polypeptide of interest is being compared which may be a PRO variant polypeptide) as determined by WU-BLAST-2 by (b) the total number of amino acid residues of the PRO polypeptide of interest. For example, in the statement "a polypeptide comprising an the amino acid sequence A which has or having at least 80% amino acid sequence identity to the amino acid sequence B", the amino acid sequence A is the comparison amino acid sequence of interest and the amino acid sequence B is the amino acid sequence of the PRO polypeptide of interest.

Percent amino acid sequence identity may also be determined using the sequence comparison program NCBI-BLAST2 (Altschul et al., *Nucleic Acids Res.* 25:3389-3402 (1997)). The NCBI-BLAST2 sequence comparison program may be obtained from the National Institute of Health, Bethesda, Md. NCBI-BLAST2 uses several search parameters, wherein all of those search parameters are set to default values including, for example, unmask=yes, strand=all, expected occurrences=10, minimum low complexity length=15/5, multi-pass e-value=0.01, constant for multi-pass=25, dropoff for final gapped alignment=25 and scoring matrix=BLOSUM62.

In situations where NCBI-BLAST2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction X/Y where X is the number of amino acid residues scored as identical matches by the sequence alignment program NCBI-BLAST2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A.

"PRO variant polynucleotide" or "PRO variant nucleic acid sequence" means a nucleic acid molecule which encodes an active PRO polypeptide as defined below and which has at least about 80% nucleic acid sequence identity with a nucleotide acid sequence encoding a full-length native sequence PRO polypeptide sequence as disclosed herein, a full-length native sequence PRO polypeptide sequence lacking the signal peptide as disclosed herein, an extracellular domain of a PRO polypeptide, with or without the signal peptide, as disclosed herein or any other fragment of a full-length PRO polypeptide sequence as disclosed herein. Ordinarily, a PRO variant polynucleotide will have at least about 80% nucleic acid sequence identity, alternatively at least about 81% nucleic acid sequence identity, alternatively at least about 82% nucleic acid sequence identity, alternatively at least about 83% nucleic acid sequence identity, alternatively at least about 84% nucleic acid sequence identity, alternatively at least about 85% nucleic acid sequence identity, alternatively at least about 86% nucleic acid sequence identity, alternatively at least about 87% nucleic acid sequence identity, alternatively at least about 88% nucleic acid sequence identity, alternatively at least about 89% nucleic acid sequence identity, alternatively at least about 90% nucleic acid sequence identity, alternatively at least about 91% nucleic acid sequence identity, alternatively at least about 92% nucleic acid sequence identity, alternatively at least about 93% nucleic acid sequence identity, alternatively at least about 94% nucleic acid sequence identity, alternatively at least about 95% nucleic acid sequence identity, alternatively at least about 96% nucleic acid sequence identity, alternatively at least about 97% nucleic acid sequence identity, alternatively at least about 98% nucleic acid sequence identity and alternatively at least about 99% nucleic acid sequence identity with a nucleic acid sequence encoding a full-length native sequence PRO polypeptide sequence as disclosed herein, a full-length native sequence PRO polypeptide sequence lacking the signal peptide as disclosed herein, an extracellular domain of a PRO polypeptide, with or without the signal sequence, as disclosed herein or any other fragment of a full-length PRO polypeptide sequence as disclosed herein. Variants do not encompass the native nucleotide sequence.

Ordinarily, PRO variant polynucleotides are at least about 30 nucleotides in length, alternatively at least about 60 nucleotides in length, alternatively at least about 90 nucleotides in length, alternatively at least about 120 nucleotides in length, alternatively at least about 150 nucleotides in length, alternatively at least about 180 nucleotides in length, alternatively at least about 210 nucleotides in length, alternatively at least about 240 nucleotides in length, alternatively at least about 270 nucleotides in length, alternatively at least about 300 nucleotides in length, alternatively at least about 450 nucleotides in length, alternatively at least about 600 nucleotides in length, alternatively at least about 900 nucleotides in length, or more.

"Percent (%) nucleic acid sequence identity" with respect to PRO-encoding nucleic acid sequences identified herein is defined as the percentage of nucleotides in a candidate sequence that are identical with the nucleotides in the PRO nucleic acid sequence of interest, after aligning the sequences and introducing gaps, if necessary, to achieve the maximum percent sequence identity. Alignment for purposes of determining percent nucleic acid sequence identity can be achieved in various ways that are within the skill in the art, for instance, using publicly available computer software such as BLAST, BLAST-2, ALIGN or Megalign (DNASTAR) software. For purposes herein, however, % nucleic acid sequence identity values are generated using the sequence comparison computer program ALIGN-2, wherein the complete source code for the ALIGN-2 program is provided in Table 1 below. The ALIGN-2 sequence comparison computer program was authored by Genentech, Inc. and the source code shown in Table 1 below has been filed with user documentation in the U.S. Copyright Office, Washington D.C., 20559, where it is registered under U.S. Copyright Registration No. TXU510087. The ALIGN-2 program is publicly available through Genentech, Inc., South San Francisco, Calif. or may be compiled from the source code provided in Table 1 below. The ALIGN-2 program should be compiled for use on a UNIX operating system, preferably digital UNIX V4.0D. All sequence comparison parameters are set by the ALIGN-2 program and do not vary.

In situations where ALIGN-2 is employed for nucleic acid sequence comparisons, the % nucleic acid sequence identity of a given nucleic acid sequence C to, with, or against a given nucleic acid sequence D (which can alternatively be phrased as a given nucleic acid sequence C that has or comprises a certain % nucleic acid sequence identity to, with, or against a given nucleic acid sequence D) is calculated as follows:

100 times the fraction W/Z where W is the number of nucleotides scored as identical matches by the sequence alignment program ALIGN-2 in that program's alignment of C and D, and where Z is the total number of nucleotides in D. It will be appreciated that where the length of nucleic acid sequence C is not equal to the length of nucleic acid sequence D, the % nucleic acid sequence identity of C to D will not equal the % nucleic acid sequence identity of D to C. As examples of % nucleic acid sequence identity calculations, Tables 4 and 5, demonstrate how to calculate the % nucleic acid sequence identity of the nucleic acid sequence designated "Comparison DNA" to the nucleic acid sequence designated "PRO-DNA", wherein "PRO-DNA" represents a hypothetical PRO-encoding nucleic acid sequence of interest, "Comparison DNA" represents the nucleotide sequence of a nucleic acid molecule against which the "PRO-DNA" nucleic acid molecule of interest is being compared, and "N", "L" and "V" each represent different hypothetical nucleotides.

Unless specifically stated otherwise, all % nucleic acid sequence identity values used herein are obtained as described in the immediately preceding paragraph using the ALIGN-2 computer program. However, % nucleic acid sequence identity values may also be obtained as described below by using the WU-BLAST-2 computer program (Altschul et al., *Methods in Enzymology* 266:460-480 (1996)). Most of the WU-BLAST-2 search parameters are set to default values. Those not set to default values, i.e., the adjustable parameters, are set with the following values: overlap span=1, overlap fraction=0.125, word threshold (T)=11, and scoring matrix=BLOSUM62. When WU-BLAST-2 is employed, a % nucleic acid sequence identity value is determined by dividing (a) the number of matching identical nucleotides between the nucleic acid sequence of the PRO polypeptide-encoding nucleic acid molecule of interest having a sequence derived from the native sequence PRO polypeptide-encoding nucleic acid and the comparison nucleic acid molecule of interest (i.e., the sequence against which the PRO polypeptide-encoding nucleic acid molecule of interest is being compared which may be a variant PRO polynucleotide) as determined by WU-BLAST-2 by (b) the total number of nucleotides of the PRO polypeptide-encoding nucleic acid molecule of interest. For example, in the statement "an isolated nucleic acid molecule comprising a nucleic acid sequence A which has or having at least 80% nucleic acid sequence identity to the nucleic acid sequence B", the nucleic acid sequence A is the comparison nucleic acid molecule of interest and the nucleic acid sequence B is the nucleic acid sequence of the PRO polypeptide-encoding nucleic acid molecule of interest.

Percent nucleic acid sequence identity may also be determined using the sequence comparison program NCBI-BLAST2 (Altschul et al., Nucleic Acids Res. 25:3389-3402 (1997)). The NCBI-BLAST2 sequence comparison program may be obtained from the National Institute of Health, Bethesda, Md. NCBI-BLAST2 uses several search parameters, wherein all of those search parameters are set to default values including, for example, unmask=yes, strand=all, expected occurrences=10, minimum low complexity length=15/5, multi-pass e-value=0.01, constant for multi-pass=25, dropoff for final gapped alignment=25 and scoring matrix=BLOSUM62.

In situations where NCBI-BLAST2 is employed for sequence comparisons, the % nucleic acid sequence identity of a given nucleic acid sequence C to, with, or against a given nucleic acid sequence D (which can alternatively be phrased as a given nucleic acid sequence C that has or comprises a certain % nucleic acid sequence identity to, with, or against a given nucleic acid sequence D) is calculated as follows:

100 times the fraction W/Z where W is the number of nucleotides scored as identical matches by the sequence alignment program NCBI-BLAST2 in that program's alignment of C and D, and where Z is the total number of nucleotides in D. It will be appreciated that where the length of nucleic acid sequence C is not equal to the length of nucleic acid sequence D, the % nucleic acid sequence identity of C to D will not equal the % nucleic acid sequence identity of D to C.

In other embodiments, PRO variant polynucleotides are nucleic acid molecules that encode an active PRO polypeptide and which are capable of hybridizing, preferably under stringent hybridization and wash conditions, to nucleotide sequences encoding a full-length PRO polypeptide as disclosed herein. PRO variant polypeptides may be those that are encoded by a PRO variant polynucleotide.

"Isolated," when used to describe the various polypeptides disclosed herein, means polypeptide that has been identified and separated and/or recovered from a component of its natural environment. Contaminant components of its natural environment are materials that would typically interfere with diagnostic or therapeutic uses for the polypeptide, and may include enzymes, hormones, and other proteinaceous or non-proteinaceous solutes. In preferred embodiments, the polypeptide will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Isolated polypeptide includes polypeptide in situ within recombinant cells, since at least one component of the PRO polypeptide natural environment will not be present. Ordinarily, however, isolated polypeptide will be prepared by at least one purification step.

An "isolated" PRO polypeptide-encoding nucleic acid or other polypeptide-encoding nucleic acid is a nucleic acid molecule that is identified and separated from at least one contaminant nucleic acid molecule with which it is ordinarily associated in the natural source of the polypeptide-encoding nucleic acid. An isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal location different from that of natural cells.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

The term "antibody" is used in the broadest sense and specifically covers, for example, single anti-PRO monoclonal antibodies (including agonist, antagonist, and neutralizing antibodies), anti-PRO antibody compositions with polyepitopic specificity, single chain anti-PRO antibodies, and fragments of anti-PRO antibodies (see below). The term "monoclonal antibody" as used herein refers to an antibody obtained from a population of substantially homogeneous antibodies, i.e., the individual antibodies comprising the population are identical except for possible naturally-occurring mutations that may be present in minor amounts.

"Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured DNA to reanneal when complementary strands are present in an environment below their melting temperature. The higher the degree of desired homology between the probe and hybridizable sequence, the higher the relative temperature which can be used. As a result, it follows that higher relative temperatures would tend to make the reaction conditions more stringent, while lower temperatures less so. For additional details and explanation of stringency of hybridization reactions, see Ausubel et al., *Current Protocols in Molecular Biology*, Wiley Interscience Publishers, (1995).

"Stringent conditions" or "high stringency conditions", as defined herein, may be identified by those that: (1) employ low ionic strength and high temperature for washing, for example 0.015 M sodium chloride/0.0015 M sodium citrate/ 0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5× Denhardt's solution, sonicated salmon sperm DNA (50 μg/ml), 0.1% SDS, and 10% dextran sulfate at 42° C., with washes at 42° C. in 0.2×SSC (sodium chloride/sodium citrate) and 50% formamide at 55° C., followed by a high-stringency wash consisting of 0.1×SSC containing EDTA at 55° C.

"Moderately stringent conditions" may be identified as described by Sambrook et al., *Molecular Cloning: A Laboratory Manual*, New York: Cold Spring Harbor Press, 1989, and include the use of washing solution and hybridization conditions (e.g., temperature, ionic strength and % SDS) less stringent that those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5×Denhardt's solution, 10% dextran sulfate, and 20 mg/ml denatured sheared salmon sperm DNA, followed by washing the filters in 1×SSC at about 37-50° C. The skilled artisan will recognize how to adjust the temperature, ionic strength, etc. as necessary to accommodate factors such as probe length and the like.

The term "epitope tagged" when used herein refers to a chimeric polypeptide comprising a PRO polypeptide fused to a "tag polypeptide". The tag polypeptide has enough residues to provide an epitope against which an antibody can be made, yet is short enough such that it does not interfere with activity of the polypeptide to which it is fused. The tag polypeptide preferably also is fairly unique so that the antibody does not substantially cross-react with other epitopes. Suitable tag polypeptides generally have at least six amino acid residues and usually between about 8 and 50 amino acid residues (preferably, between about 10 and 20 amino acid residues).

As used herein, the term "immunoadhesin" designates antibody-like molecules which combine the binding specificity of a heterologous protein (an "adhesin") with the effector functions of immunoglobulin constant domains. Structurally, the immunoadhesins comprise a fusion of an amino acid sequence with the desired binding specificity which is other than the antigen recognition and binding site of an antibody (i.e., is "heterologous"), and an immunoglobulin constant domain sequence. The adhesin part of an immunoadhesin molecule typically is a contiguous amino acid sequence comprising at least the binding site of a receptor or a ligand. The immunoglobulin constant domain sequence in the immunoadhesin may be obtained from any immunoglobulin, such as IgG-1, IgG-2, IgG-3, or IgG-4 subtypes, IgA (including IgA-1 and IgA-2), IgE, IgD or IgM.

"Active" or "activity" for the purposes herein refers to form(s) of a PRO polypeptide which retain a biological and/or an immunological activity of native or naturally-occurring PRO, wherein "biological" activity refers to a biological function (either inhibitory or stimulatory) caused by a native or naturally-occurring PRO other than the ability to induce the production of an antibody against an antigenic epitope possessed by a native or naturally-occurring PRO and an "immunological" activity refers to the ability to induce the production of an antibody against an antigenic epitope possessed by a native or naturally-occurring PRO.

The term "antagonist" is used in the broadest sense, and includes any molecule that partially or fully blocks, inhibits, or neutralizes a biological activity of a native PRO polypeptide disclosed herein. In a similar manner, the term "agonist" is used in the broadest sense and includes any molecule that mimics a biological activity of a native PRO polypeptide disclosed herein. Suitable agonist or antagonist molecules specifically include agonist or antagonist antibodies or antibody fragments, fragments or amino acid sequence variants of native PRO polypeptides, peptides, antisense oligonucleotides, small organic molecules, etc. Methods for identifying agonists or antagonists of a PRO polypeptide may comprise contacting a PRO polypeptide with a candidate agonist or antagonist molecule and measuring a detectable change in one or more biological activities normally associated with the PRO polypeptide.

"Treatment" refers to both therapeutic treatment and prophylactic or preventative measures, wherein the object is to prevent or slow down (lessen) the targeted pathologic condition or disorder. Those in need of treatment include those already with the disorder as well as those prone to have the disorder or those in whom the disorder is to be prevented.

"Chronic" administration refers to administration of the agent(s) in a continuous mode as opposed to an acute mode, so as to maintain the initial therapeutic effect (activity) for an extended period of time. "Intermittent" administration is treatment that is not consecutively done without interruption, but rather is cyclic in nature.

"Mammal" for purposes of treatment refers to any animal classified as a mammal, including humans, domestic and farm animals, and zoo, sports, or pet animals, such as dogs, cats, cattle, horses, sheep, pigs, goats, rabbits, etc. Preferably, the mammal is human.

Administration "in combination with" one or more further therapeutic agents includes simultaneous (concurrent) and consecutive administration in any order.

"Carriers" as used herein include pharmaceutically acceptable carriers, excipients, or stabilizers which are nontoxic to the cell or mammal being exposed thereto at the dosages and concentrations employed. Often the physiologically acceptable carrier is an aqueous pH buffered solution. Examples of physiologically acceptable carriers include buffers such as phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™, polyethylene glycol (PEG), and PLURONICS™.

"Antibody fragments" comprise a portion of an intact antibody, preferably the antigen binding or variable region of the intact antibody. Examples of antibody fragments include Fab, Fab', F(ab')$_2$, and Fv fragments; diabodies; linear antibodies (Zapata et al., Protein Eng. 8(10): 1057-1062 [1995]); single-chain antibody molecules; and multispecific antibodies formed from antibody fragments.

Papain digestion of antibodies produces two identical antigen-binding fragments, called "Fab" fragments, each with a single antigen-binding site, and a residual "Fc" fragment, a designation reflecting the ability to crystallize readily. Pepsin treatment yields an F(ab')$_2$ fragment that has two antigen-combining sites and is still capable of cross-linking antigen.

"Fv" is the minimum antibody fragment which contains a complete antigen-recognition and -binding site. This region consists of a dimer of one heavy- and one light-chain variable domain in tight, non-covalent association. It is in this configuration that the three CDRs of each variable domain interact to define an antigen-binding site on the surface of the $V_H$-$V_L$ dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The Fab fragment also contains the constant domain of the light chain and the first constant domain (CH1) of the heavy chain. Fab fragments differ from Fab' fragments by the addition of a few residues at the carboxy terminus of the heavy chain CH1 domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments which have hinge cysteines between them. Other chemical couplings of antibody fragments are also known.

The "light chains" of antibodies (immunoglobulins) from any vertebrate species can be assigned to one of two clearly distinct types, called kappa and lambda, based on the amino acid sequences of their constant domains.

Depending on the amino acid sequence of the constant domain of their heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA, and IgA2.

"Single-chain Fv" or "sFv" antibody fragments comprise the $V_H$ and $V_L$ domains of antibody, wherein these domains are present in a single polypeptide chain. Preferably, the Fv polypeptide further comprises a polypeptide linker between the $V_H$ and $V_L$ domains which enables the sFv to form the desired structure for antigen binding. For a review of sFv, see Pluckthun in *The Pharmacology of Monoclonal Antibodies*, vol. 113, Rosenburg and Moore eds., Springer-Verlag, New York, pp. 269-315 (1994).

The term "diabodies" refers to small antibody fragments with two antigen-binding sites, which fragments comprise a heavy-chain variable domain ($V_H$) connected to a light-chain variable domain ($V_L$) in the same polypeptide chain ($V_H$-$V_L$). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al., *Proc. Natl. Acad. Sci. USA*, 90:6444-6448 (1993).

An "isolated" antibody is one which has been identified and separated and/or recovered from a component of its natural environment. Contaminant components of its natural environment are materials which would interfere with diagnostic or therapeutic uses for the antibody, and may include enzymes, hormones, and other proteinaceous or nonproteinaceous solutes. In preferred embodiments, the antibody will be purified (1) to greater than 95% by weight of antibody as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step.

An antibody that "specifically binds to" or is "specific for" a particular polypeptide or an epitope on a particular polypeptide is one that binds to that particular polypeptide or epitope on a particular polypeptide without substantially binding to any other polypeptide or polypeptide epitope.

The word "label" when used herein refers to a detectable compound or composition which is conjugated directly or indirectly to the antibody so as to generate a "labeled" antibody. The label may be detectable by itself (e.g. radioisotope labels or fluorescent labels) or, in the case of an enzymatic label, may catalyze chemical alteration of a substrate compound or composition which is detectable.

By "solid phase" is meant a non-aqueous matrix to which the antibody of the present invention can adhere. Examples of solid phases encompassed herein include those formed partially or entirely of glass (e.g., controlled pore glass), polysaccharides (e.g., agarose), polyacrylamides, polystyrene, polyvinyl alcohol and silicones. In certain embodiments, depending on the context, the solid phase can comprise the well of an assay plate; in others it is a purification column (e.g., an affinity chromatography column). This term also includes a discontinuous solid phase of discrete particles, such as those described in U.S. Pat. No. 4,275,149.

A "liposome" is a small vesicle composed of various types of lipids, phospholipids and/or surfactant which is useful for delivery of a drug (such as a PRO polypeptide or antibody thereto) to a mammal. The components of the liposome are commonly arranged in a bilayer formation, similar to the lipid arrangement of biological membranes.

A "small molecule" is defined herein to have a molecular weight below about 500 Daltons.

An "effective amount" of a polypeptide disclosed herein or an agonist or antagonist thereof is an amount sufficient to carry out a specifically stated purpose. An "effective amount" may be determined empirically and in a routine manner, in relation to the stated purpose.

Table 1

```
/*
 *
 * C-C increased from 12 to 15
 * Z is average of EQ
 * B is average of ND
 * match with stop is _M; stop-stop = 0; J (joker) match = 0
 */
define    _M      -8      /* value of a match with a stop */ int      _day[26][26] = {
/*       A  B  C  D  E  F  G  H  I  J  K  L  M  N  O  P  Q  R  S  T  U  V  W  X  Y  Z */
/* A */  { 2, 0,-2, 0, 0,-4, 1,-1,-1, 0,-1,-2,-1, 0,_M, 1, 0,-2, 1, 1, 0, 0,-6, 0,-3, 0},
/* B */  { 0, 3,-4, 3, 2,-5, 0, 1,-2, 0, 0,-3,-2, 2,_M,-1, 1, 0, 0, 0, 0,-2,-5, 0,-3, 1},
/* C */  {-2,-4,15,-5,-5,-4,-3,-3,-2, 0,-5,-6,-5,-4,_M,-3,-5,-4, 0,-2, 0,-2,-8, 0, 0,-5},
/* D */  { 0, 3,-5, 4, 3,-6, 1, 1,-2, 0, 0,-4,-3, 2,_M,-1, 2,-1, 0, 0, 0,-2,-7, 0,-4, 2},
/* E */  { 0, 2,-5, 3, 4,-5, 0, 1,-2, 0, 0,-3,-2, 1,_M,-1, 2,-1, 0, 0, 0,-2,-7, 0,-4, 3},
/* F */  {-4,-5,-4,-6,-5, 9,-5,-2, 1, 0,-5, 2, 0,-4,_M,-5,-5,-4,-3,-3, 0,-1, 0, 0, 7,-5},
/* G */  { 1, 0,-3, 1, 0,-5, 5,-2,-3, 0,-2,-4,-3, 0,_M,-1,-1,-3, 1, 0, 0,-1,-7, 0,-5, 0},
/* H */  {-1, 1,-3, 1, 1,-2,-2, 6,-2, 0, 0,-2,-2, 2,_M, 0, 3, 2,-1,-1, 0,-2,-3, 0, 0, 2},
/* I */  {-1,-2,-2,-2,-2, 1,-3,-2, 5, 0,-2, 2, 2,-2,_M,-2,-2,-2,-1, 0, 0, 4,-5, 0,-1,-2},
/* J */  { 0, 0, 0, 0, 0, 0, 0, 0, 0, 0, 0, 0, 0, 0,_M, 0, 0, 0, 0, 0, 0, 0, 0, 0, 0, 0},
/* K */  {-1, 0,-5, 0, 0,-5,-2, 0,-2, 0, 5,-3, 0, 1,_M,-1, 1, 3, 0, 0, 0,-2,-3, 0,-4, 0},
/* L */  {-2,-3,-6,-4,-3, 2,-4,-2, 2, 0,-3, 6, 4,-3,_M,-3,-2,-3,-3,-1, 0, 2,-2, 0,-1,-2},
/* M */  {-1,-2,-5,-3,-2, 0,-3,-2, 2, 0, 0, 4, 6,-2,_M,-2,-1, 0,-2,-1, 0, 2,-4, 0,-2,-1},
/* N */  { 0, 2,-4, 2, 1,-4, 0, 2,-2, 0, 1,-3,-2, 2,_M,-1, 1, 0, 1, 0, 0,-2,-4, 0,-2, 1},
/* O */  {_M,_M,_M,_M,_M,_M,_M,_M,_M,_M,_M,_M,_M,_M, 0,_M,_M,_M,_M,_M,_M,_M,_M,_M,_M,_M},
/* P */  { 1,-1,-3,-1,-1,-5,-1, 0,-2, 0,-1,-3,-2,-1,_M, 6, 0, 0, 1, 0, 0,-1,-6, 0,-5, 0},
/* Q */  { 0, 1,-5, 2, 2,-5,-1, 3,-2, 0, 1,-2,-1, 1,_M, 0, 4, 1,-1,-1, 0,-2,-5, 0,-4, 3},
/* R */  {-2, 0,-4,-1,-1,-4,-3, 2,-2, 0, 3,-3, 0, 0,_M, 0, 1, 6, 0,-1, 0, 2,-2, 0,-4, 0},
/* S */  { 1, 0, 0, 0, 0,-3, 1,-1,-1, 0, 0,-3,-2, 1,_M, 1,-1, 0, 2, 1, 0,-1,-2, 0,-3, 0},
/* T */  { 1, 0,-2, 0, 0,-3, 0,-1, 0, 0, 0,-1,-1, 0,_M, 0,-1,-1, 1, 3, 0, 0,-5, 0,-3, 0},
/* U */  { 0, 0, 0, 0, 0, 0, 0, 0, 0, 0, 0, 0, 0, 0,_M, 0, 0, 0, 0, 0, 0, 0, 0, 0, 0, 0},
/* V */  { 0,-2,-2,-2,-2,-1,-1,-2, 4, 0,-2, 2, 2,-2,_M,-1,-2,-2,-1, 0, 0, 4,-6, 0,-2,-2},
/* W */  {-6,-5,-8,-7,-7, 0,-7,-3,-5, 0,-3,-2,-4,-4,_M,-6,-5, 2,-2,-5, 0,-6,17, 0, 0,-6},
/* X */  { 0, 0, 0, 0, 0, 0, 0, 0, 0, 0, 0, 0, 0, 0,_M, 0, 0, 0, 0, 0, 0, 0, 0, 0, 0, 0},
/* Y */  {-3,-3, 0,-4,-4, 7,-5, 0,-1, 0,-4,-1,-2,-2,_M,-5,-4,-4,-3,-3, 0,-2, 0, 0,10,-4},
/* Z */  { 0, 1,-5, 2, 3,-5, 0, 2,-2, 0, 0,-2,-1, 1,_M, 0, 3, 0, 0, 0, 0,-2,-6, 0,-4, 4}
};
```

Table 1 (cont')

```
/*
*/
#include <stdio.h>
include <ctype.h> define  MAXJMP   16      /* max jumps in a diag */
define  MAXGAP   24      /* don't continue to penalize gaps larger than this */
#define  JMPS     1024    /* max jmps in an path */
define  MX       4       /* save if there's at least MX-1 bases since last jmp */ define  DMAT     3       /* value of matching bases */
define  DMIS     0       /* penalty for mismatched bases */
#define  DINS0    8       /* penalty for a gap */
#define  DINS1    1       /* penalty per base */
#define  PINS0    8       /* penalty for a gap */
define  PINS1    4       /* penalty per residue */ struct jmp {
        short         n[MAXJMP];      /* size of jmp (neg for dely) */
        unsigned short x[MAXJMP];     /* base no. of jmp in seq x */
};                                    /* limits seq to 2^16 -1 */ struct diag {
        int           score;          /* score at last jmp */
        long          offset;         /* offset of prev block */
        short         ijmp;           /* current jmp index */
        struct jmp    jp;             /* list of jmps */
};

struct path {
        int           spc;            /* number of leading spaces */
        short         n[JMPS];        /* size of jmp (gap) */
        int           x[JMPS];        /* loc of jmp (last elem before gap) */
};

char          *ofile;                 /* output file name */
char          *namex[2];              /* seq names: getseqs() */
char          *prog;                  /* prog name for err msgs */
char          *seqx[2];               /* seqs: getseqs() */
int           dmax;                   /* best diag: nw() */
int           dmax0;                  /* final diag */
int           dna;                    /* set if dna: main() */
int           endgaps;                /* set if penalizing end gaps */
int           gapx, gapy;             /* total gaps in seqs */
int           len0, len1;             /* seq lens */
int           ngapx, ngapy;           /* total size of gaps */
int           smax;                   /* max score: nw() */
int           *xbm;                   /* bitmap for matching */
long          offset;                 /* current offset in jmp file */
struct diag   *dx;                    /* holds diagonals */
struct path   pp[2];                  /* holds path for seqs */ char          *calloc(), *malloc(), *index(), *strcpy();
char          *getseq(), *g_calloc();
```

Table 1 (cont')

```
/* Needleman-Wunsch alignment program
 *
 * usage: progs file1 file2
 *   where file1 and file2 are two dna or two protein sequences.
 *   The sequences can be in upper- or lower-case an may contain ambiguity
 *   Any lines beginning with ';', '>' or '<' are ignored
 *   Max file length is 65535 (limited by unsigned short x in the jmp struct)
 *   A sequence with 1/3 or more of its elements ACGTU is assumed to be DNA
 *   Output is in the file "align.out"
 *
 * The program may create a tmp file in /tmp to hold info about traceback.
 * Original version developed under BSD 4.3 on a vax 8650
 */
include "nw.h"
#include "day.h"

static  _dbval[26] = {
    1,14,2,13,0,0,4,11,0,0,12,0,3,15,0,0,0,5,6,8,8,7,9,0,10,0
};

static  _pbval[26] = {
    1, 2|(1<<('D'-'A'))|(1<<('N'-'A')), 4, 8, 16, 32, 64,
    128, 256, 0xFFFFFFF, 1<<10, 1<<11, 1<<12, 1<<13, 1<<14,
    1<<15, 1<<16, 1<<17, 1<<18, 1<<19, 1<<20, 1<<21, 1<<22,
    1<<23, 1<<24, 1<<25|(1<<('E'-'A'))|(1<<('Q'-'A'))
};

main(ac, av)                                                                    main
        int     ac;
        char    *av[];
{
        prog = av[0];
        if (ac != 3) {
                fprintf(stderr,"usage: %s file1 file2\n", prog);
                fprintf(stderr,"where file1 and file2 are two dna or two protein sequences.\n");
                fprintf(stderr,"The sequences can be in upper- or lower-case\n");
                fprintf(stderr,"Any lines beginning with ';' or '<' are ignored\n");
                fprintf(stderr,"Output is in the file \"align.out\"\n");
                exit(1);
        }
        namex[0] = av[1];
        namex[1] = av[2];
        seqx[0] = getseq(namex[0], &len0);
        seqx[1] = getseq(namex[1], &len1);
        xbm = (dna)? _dbval : _pbval;

endgaps = 0;            /* 1 to penalize endgaps */
        ofile = "align.out";    /* output file */ nw();                   /* fill in the matrix, get the possible jmps */
        readjmps();             /* get the actual jmps */
        print();                /* print stats, alignment */ cleanup(0);             /* unlink any tmp files */
}
```

Table 1 (cont')

```
/* do the alignment, return best score: main()
 * dna: values in Fitch and Smith, PNAS, 80, 1382-1386, 1983
 * pro: PAM 250 values
 * When scores are equal, we prefer mismatches to any gap, prefer
 * a new gap to extending an ongoing gap, and prefer a gap in seqx
 * to a gap in seq y.
 */
nw()                                                                            nw
{
        char      *px, *py;        /* seqs and ptrs */
        int       *ndely, *dely;   /* keep track of dely */
        int       ndelx, delx;     /* keep track of delx */
        int       *tmp;            /* for swapping row0, row1 */
        int       mis;             /* score for each type */
        int       ins0, ins1;      /* insertion penalties */
        register  id;              /* diagonal index */
        register  ij;              /* jmp index */
        register  *col0, *col1;    /* score for curr, last row */
        register  xx, yy;          /* index into seqs */ dx = (struct diag *)g_calloc("to get diags", len0+len1+1, sizeof(struct diag));

ndely = (int *)g_calloc("to get ndely", len1+1, sizeof(int));
        dely  = (int *)g_calloc("to get dely",  len1+1, sizeof(int));
        col0  = (int *)g_calloc("to get col0",  len1+1, sizeof(int));
        col1  = (int *)g_calloc("to get col1",  len1+1, sizeof(int));
        ins0  = (dna)? DINS0 : PINS0;
        ins1  = (dna)? DINS1 : PINS1;

smax = -10000;
        if (endgaps) {
                for (col0[0] = dely[0] = -ins0, yy = 1; yy <= len1; yy++) {
                        col0[yy] = dely[yy] = col0[yy-1] - ins1;
                        ndely[yy] = yy;
                }
                col0[0] = 0;        /* Waterman Bull Math Biol 84 */
        }
        else
                for (yy = 1; yy <= len1; yy++)
                        dely[yy] = -ins0;

/* fill in match matrix
         */
        for (px = seqx[0], xx = 1; xx <= len0; px++, xx++) {
                /* initialize first entry in col
                 */
                if (endgaps) {
                        if (xx == 1)
                                col1[0] = delx = -(ins0+ins1);
                        else
                                col1[0] = delx = col0[0] - ins1;
                        ndelx = xx;
                }
                else {
                        col1[0] = 0;
                        delx = -ins0;
                        ndelx = 0;
                }
```

Table 1 (cont')

...nw

```
for (py = seqx[1], yy = 1; yy <= len1; py++, yy++) {
        mis = col0[yy-1];
        if (dna)
                mis += (xbm[*px-'A']&xbm[*py-'A'])? DMAT : DMIS;
        else
                mis += _day[*px-'A'][*py-'A'];

/* update penalty for del in x seq;
         * favor new del over ongong del
         * ignore MAXGAP if weighting endgaps
         */
        if (endgaps || ndely[yy] < MAXGAP) {
                    if (col0[yy] - ins0 >= dely[yy]) {
                            dely[yy] = col0[yy] - (ins0+ins1);
                            ndely[yy] = 1;
                    } else {
                            dely[yy] -= ins1;
                            ndely[yy]++;
                    }
        } else {
                    if (col0[yy] - (ins0+ins1) >= dely[yy]) {
                            dely[yy] = col0[yy] - (ins0+ins1);
                            ndely[yy] = 1;
                    } else
                            ndely[yy]++;
        }

/* update penalty for del in y seq;
         * favor new del over ongong del
         */
        if (endgaps || ndelx < MAXGAP) {
                    if (col1[yy-1] - ins0 >= delx) {
                            delx = col1[yy-1] - (ins0+ins1);
                            ndelx = 1;
                    } else {
                            delx -= ins1;
                            ndelx++;
                    }
        } else {
                    if (col1[yy-1] - (ins0+ins1) >= delx) {
                            delx = col1[yy-1] - (ins0+ins1);
                            ndelx = 1;
                    } else
                            ndelx++;
        }

/* pick the maximum score; we're favoring
         * mis over any del and delx over dely
         */
```

Table 1 (cont')

...nw

```
                id = xx - yy + len1 - 1;
                if (mis >= delx && mis >= dely[yy])
                        col1[yy] = mis;
                else if (delx >= dely[yy]) {
                        col1[yy] = delx;
                        ij = dx[id].ijmp;
                        if (dx[id].jp.n[0] && (!dna || (ndelx >= MAXJMP
                                && xx > dx[id].jp.x[ij]+MX) || mis > dx[id].score+DINS0)) {
                                dx[id].ijmp++;
                                if (++ij >= MAXJMP) {
                                        writejmps(id);
                                        ij = dx[id].ijmp = 0;
                                        dx[id].offset = offset;
                                        offset += sizeof(struct jmp) + sizeof(offset);
                                }
                        }
                        dx[id].jp.n[ij] = ndelx;
                        dx[id].jp.x[ij] = xx;
                        dx[id].score = delx;
                }
                else {
                        col1[yy] = dely[yy];
                        ij = dx[id].ijmp;
        if (dx[id].jp.n[0] && (!dna || (ndely[yy] >= MAXJMP
                                && xx > dx[id].jp.x[ij]+MX) || mis > dx[id].score+DINS0)) {
                                dx[id].ijmp++;
                                if (++ij >= MAXJMP) {
                                        writejmps(id);
                                        ij = dx[id].ijmp = 0;
                                        dx[id].offset = offset;
                                        offset += sizeof(struct jmp) + sizeof(offset);
                                }
                        }
                        dx[id].jp.n[ij] = -ndely[yy];
                        dx[id].jp.x[ij] = xx;
                        dx[id].score = dely[yy];
                }
                if (xx == len0 && yy < len1) {
                        /* last col
                         */
                        if (endgaps)
                                col1[yy] -= ins0+ins1*(len1-yy);
                        if (col1[yy] > smax) {
                                smax = col1[yy];
                                dmax = id;
                        }
                }
        }
        if (endgaps && xx < len0)
                col1[yy-1] -= ins0+ins1*(len0-xx);
        if (col1[yy-1] > smax) {
                smax = col1[yy-1];
                dmax = id;
        }
        tmp = col0; col0 = col1; col1 = tmp;
}
(void) free((char *)ndely);
(void) free((char *)dely);
(void) free((char *)col0);
(void) free((char *)col1);                              }
```

Table 1 (cont')

```
/*
*
* print() -- only routine visible outside this module
*
* static:
* getmat() -- trace back best path, count matches: print()
* pr_align() -- print alignment of described in array p[]: print()
* dumpblock() -- dump a block of lines with numbers, stars: pr_align()
* nums() -- put out a number line: dumpblock()
* putline() -- put out a line (name, [num], seq, [num]): dumpblock()
* stars() - -put a line of stars: dumpblock()
* stripname() -- strip any path and prefix from a seqname
*/ include "nw.h"

define SPC      3
#define P_LINE   256    /* maximum output line */
define P_SPC    3      /* space between name or num and seq */ extern   _day[26][26];
int      olen;          /* set output line length */
FILE     *fx;           /* output file */ print()                                                              print
{
         int     lx, ly, firstgap, lastgap;    /* overlap */ if ((fx = fopen(ofile, "w")) == 0) {
                 fprintf(stderr,"%s: can't write %s\n", prog, ofile);
                 cleanup(1);
         }
         fprintf(fx, "<first sequence: %s (length = %d)\n", namex[0], len0);
         fprintf(fx, "<second sequence: %s (length = %d)\n", namex[1], len1);
         olen = 60;
         lx = len0;
         ly = len1;
         firstgap = lastgap = 0;
         if (dmax < len1 - 1) {       /* leading gap in x */
                 pp[0].spc = firstgap = len1 - dmax - 1;
                 ly -= pp[0].spc;
         }
         else if (dmax > len1 - 1) {  /* leading gap in y */
                 pp[1].spc = firstgap = dmax - (len1 - 1);
                 lx -= pp[1].spc;
         }
         if (dmax0 < len0 - 1) {      /* trailing gap in x */
                 lastgap = len0 - dmax0 -1;
                 lx -= lastgap;
         }
         else if (dmax0 > len0 - 1) { /* trailing gap in y */
                 lastgap = dmax0 - (len0 - 1);
                 ly -= lastgap;
         }
         getmat(lx, ly, firstgap, lastgap);
         pr_align();
}
```

Table 1 (cont')

```
/*
 * trace back the best path, count matches
 */
static
getmat(lx, ly, firstgap, lastgap)                                          getmat
        int     lx, ly;                 /* "core" (minus endgaps) */
        int     firstgap, lastgap;      /* leading trailing overlap */
{
        int             nm, i0, i1, siz0, siz1;
        char            outx[32];
        double          pct;
        register        n0, n1;
        register char   *p0, *p1;

/* get total matches, score
         */
        i0 = i1 = siz0 = siz1 = 0;
        p0 = seqx[0] + pp[1].spc;
        p1 = seqx[1] + pp[0].spc;
        n0 = pp[1].spc + 1;
        n1 = pp[0].spc + 1;

nm = 0;
        while ( *p0 && *p1 ) {
                if (siz0) {
                        p1++;
                        n1++;
                        siz0--;
                }
                else if (siz1) {
                        p0++;
                        n0++;
                        siz1--;
                }
                else {
                        if (xbm[*p0-'A']&xbm[*p1-'A'])
                                nm++;
                        if (n0++ == pp[0].x[i0])
                                siz0 = pp[0].n[i0++];
                        if (n1++ == pp[1].x[i1])
                                siz1 = pp[1].n[i1++];
                        p0++;
                        p1++;
                }
        }

/* pct homology:
         * if penalizing endgaps, base is the shorter seq
         * else, knock off overhangs and take shorter core
         */
        if (endgaps)
                lx = (len0 < len1)? len0 : len1;
        else
                lx = (lx < ly)? lx : ly;
        pct = 100.*(double)nm/(double)lx;
        fprintf(fx, "\n");
        fprintf(fx, " <%d match%s in an overlap of %d: %.2f percent similarity\n",
                nm, (nm == 1)? "" : "es", lx, pct);
```

Table 1 (cont')

```
                                                                           ...getmat
fprintf(fx, " <gaps in first sequence: %d", gapx);
if (gapx) {
        (void) sprintf(outx, " (%d %s%s)",
                  ngapx, (dna)? "base":"residue", (ngapx == 1)? "":"s");
        fprintf(fx,"%s", outx);
} fprintf(fx, ", gaps in second sequence: %d", gapy);
if (gapy) {
        (void) sprintf(outx, " (%d %s%s)",
                  ngapy, (dna)? "base":"residue", (ngapy == 1)? "":"s");
        fprintf(fx,"%s", outx);
}
if (dna)
        fprintf(fx,
        "\n<score: %d (match = %d, mismatch = %d, gap penalty = %d + %d per base)\n",
        smax, DMAT, DMIS, DINS0, DINS1);
else
        fprintf(fx,
        "\n<score: %d (Dayhoff PAM 250 matrix, gap penalty = %d + %d per residue)\n",
        smax, PINS0, PINS1);
if (endgaps)
        fprintf(fx, .
        " <endgaps penalized. left endgap: %d %s%s, right endgap: %d %s%s\n",
        firstgap, (dna)? "base" : "residue", (firstgap == 1)? "" : "s",
        lastgap, (dna)? "base" : "residue", (lastgap == 1)? "" : "s");
else
        fprintf(fx, " <endgaps not penalized\n");
} static       nm;              /* matches in core -- for checking */
static       lmax;            /* lengths of stripped file names */
static       ij[2];           /* jmp index for a path */
static       nc[2];           /* number at start of current line */
static       ni[2],           /* current elem number -- for gapping */
static       siz[2];
static char  *ps[2];          /* ptr to current element */
static char  *po[2];          /* ptr to next output char slot */
static char  out[2][P_LINE];  /* output line */
static char  star[P_LINE];    /* set by stars() */

/*
 * print alignment of described in struct path pp[]
 */
static
pr_align()                                                               pr_align
{
        int          nn;      /* char count */
        int          more;
        register     i;

for (i = 0, lmax = 0; i < 2; i++) {
                nn = stripname(namex[i]);
                if (nn > lmax)
                        lmax = nn;

nc[i] = 1;
                ni[i] = 1;
                siz[i] = ij[i] = 0;
                ps[i] = seqx[i];
                po[i] = out[i];                                  }
```

Table 1 (cont')

```
for (nn = nm = 0, more = 1; more; ) {                              ...pr_align
    for (i = more = 0; i < 2; i++) {
        /*
         * do we have more of this sequence?
         */
        if (!*ps[i])
                continue;

more++;

if (pp[i].spc) {        /* leading space */
                *po[i]++ = ' ';
                pp[i].spc--;
        }
        else if (siz[i]) {      /* in a gap */
                *po[i]++ = '-';
                siz[i]--;
        }
        else {                  /* we're putting a seq element
                                 */
                *po[i] = *ps[i];
                if (islower(*ps[i]))
                        *ps[i] = toupper(*ps[i]);
                po[i]++;
                ps[i]++;

/*
                 * are we at next gap for this seq?
                 */
                if (ni[i] == pp[i].x[ij[i]]) {
                        /*
                         * we need to merge all gaps
                         * at this location
                         */
                        siz[i] = pp[i].n[ij[i]++];
                        while (ni[i] == pp[i].x[ij[i]])
                                siz[i] += pp[i].n[ij[i]++];
                }
                ni[i]++;
        }
    }
    if (++nn == olen || !more && nn) {
        dumpblock();
        for (i = 0; i < 2; i++)
                po[i] = out[i];
        nn = 0;
    }
  }
}

/*
 * dump a block of lines, including numbers, stars: pr_align()
 */
static
dumpblock()                                                         dumpblock
{
    register i;

for (i = 0; i < 2; i++)
        *po[i]-- = '\0';
```

Table 1 (cont')

...dumpblock

```
                (void) putc('\n', fx);
                for (i = 0; i < 2; i++) {
                        if (*out[i] && (*out[i] != ' ' || *(po[i]) != ' ')) {
                                if (i == 0)
                                        nums(i);
                                if (i == 0 && *out[1])
                                        stars();
                                putline(i);
                                if (i == 0 && *out[1])
                                        fprintf(fx, star);
                                if (i == 1)
                                        nums(i);
                        }
                }
        }
}
/*
 * put out a number line: dumpblock()
 */
static
nums(ix)                                                                                                nums
        int     ix;     /* index in out[] holding seq line */
{
        char            nline[P_LINE];
        register        i, j;
        register char   *pn, *px, *py;

for (pn = nline, i = 0; i < lmax+P_SPC; i++, pn++)
                *pn = ' ';
        for (i = nc[ix], py = out[ix]; *py; py++, pn++) {
                if (*py == ' ' || *py == '-')
                        *pn = ' ';
                else {
                        if (i%10 == 0 || (i == 1 && nc[ix] != 1)) {
                                j = (i < 0)? -i : i;
                                for (px = pn; j; j /= 10, px--)
                                        *px = j%10 + '0';
                                if (i < 0)
                                        *px = '-';
                        }
                        else
                                *pn = ' ';
                        i++;
                }
        }
        *pn = '\0';
        nc[ix] = i;
        for (pn = nline; *pn; pn++)
                (void) putc(*pn, fx);
        (void) putc('\n', fx);
}
/*
 * put out a line (name, [num], seq, [num]): dumpblock()
 */
static
putline(ix)                                                                                             putline
        int     ix;                                     {
```

Table 1 (cont')

...putline

```
        int             i;
        register char   *px;

for (px = namex[ix], i = 0; *px && *px != ':'; px++, i++)
                (void) putc(*px, fx);
        for (; i < lmax+P_SPC; i++)
                (void) putc(' ', fx);

/* these count from 1:
         * ni[] is current element (from 1)
         * nc[] is number at start of current line
         */
        for (px = out[ix]; *px; px++)
                (void) putc(*px&0x7F, fx);
        (void) putc('\n', fx);
}

/*
 * put a line of stars (seqs always in out[0], out[1]): dumpblock()
 */
static
stars()                                                                  stars
{
        int             i;
        register char   *p0, *p1, cx, *px;

if (!*out[0] || (*out[0] == ' ' && *(po[0]) == ' ') ||
            !*out[1] || (*out[1] == ' ' && *(po[1]) == ' '))
                return;
        px = star;
        for (i = lmax+P_SPC; i; i--)
                *px++ = ' ';

for (p0 = out[0], p1 = out[1]; *p0 && *p1; p0++, p1++) {
                if (isalpha(*p0) && isalpha(*p1)) { if (xbm[*p0-'A']&xbm[*p1-'A']) {
                                cx = '*';
                                nm++;
                        }
                        else if (!dna && _day[*p0-'A'][*p1-'A'] > 0)
                                cx = '.';
                        else
                                cx = ' ';
                }
                else
                        cx = ' ';
                *px++ = cx;
        }
        *px++ = '\n';
        *px = '\0';
}
```

Table 1 (cont')

```
/*
 * strip path or prefix from pn, return len: pr_align()
 */
static
stripname(pn)                                                              stripname
        char    *pn;     /* file name (may be path) */
{
        register char    *px, *py;

py = 0;
        for (px = pn; *px; px++)
                if (*px == '/')
                        py = px + 1;
        if (py)
                (void) strcpy(pn, py);
        return(strlen(pn));

}
```

Table 1 (cont')

```
/*
* cleanup() -- cleanup any tmp file
* getseq() -- read in seq, set dna, len, maxlen
* g_calloc() -- calloc() with error checkin
* readjmps() -- get the good jmps, from tmp file if necessary
* writejmps() -- write a filled array of jmps to a tmp file: nw()
*/
include "nw.h"
include <sys/file.h> char     *jname = "/tmp/homgXXXXXX";      /* tmp file for jmps */
FILE     *fj;

int      cleanup();                        /* cleanup tmp file */
long     lseek();

/*
* remove any tmp file if we blow
*/
cleanup(i)                                                                          cleanup
         int     i;
{
         if (fj)
                 (void) unlink(jname);
         exit(i);
}

/*
* read, return ptr to seq, set dna, len, maxlen
* skip lines starting with ';', '<', or '>'
* seq in upper or lower case
*/
char     *
getseq(file, len)                                                                   getseq
         char    *file;    /* file name */
         int     *len;     /* seq len */
{
         char              line[1024], *pseq;
         register char     *px, *py;
         int               natgc, tlen;
         FILE              *fp;

if ((fp = fopen(file,"r")) == 0) {
                 fprintf(stderr,"%s: can't read %s\n", prog, file);
                 exit(1);
         }
         tlen = natgc = 0;
         while (fgets(line, 1024, fp)) {
                 if (*line == ';' || *line == '<' || *line == '>')
                         continue;
                 for (px = line; *px != '\n'; px++)
                         if (isupper(*px) || islower(*px))
                                 tlen++;
         }
         if ((pseq = malloc((unsigned)(tlen+6))) == 0) {
                 fprintf(stderr,"%s: malloc() failed to get %d bytes for %s\n", prog, tlen+6, file);
                 exit(1);
         }
         pseq[0] = pseq[1] = pseq[2] = pseq[3] = '\0';
```

Table 1 (cont')

...getseq

```
            py = pseq + 4;
            *len = tlen;
            rewind(fp);

while (fgets(line, 1024, fp)) {
                    if (*line == ';' || *line == '<' || *line == '>')
                            continue;
                    for (px = line; *px != '\n'; px++) {
                            if (isupper(*px))
                                    *py++ = *px;
                            else if (islower(*px))
                                    *py++ = toupper(*px);
                            if (index("ATGCU",*(py-1)))
                                    natgc++;
                    }
            }
            *py++ = '\0';
            *py = '\0';
            (void) fclose(fp);
            dna = natgc > (tlen/3);
            return(pseq+4);
} char    *
g_calloc(msg, nx, sz)
            char    *msg;            /* program, calling routine */
            int     nx, sz;          /* number and size of elements */
{
            char    *px, *calloc();

if ((px = calloc((unsigned)nx, (unsigned)sz)) == 0) {
                    if (*msg) {
                            fprintf(stderr, "%s: g_calloc() failed %s (n=%d, sz=%d)\n", prog, msg, nx, sz);
                            exit(1);
                    }
            }
            return(px);
}

/*
 * get final jmps from dx[] or tmp file, set pp[], reset dmax: main()
 */
readjmps()
{
            int     fd = -1;
            int     siz, i0, i1;
            register i, j, xx;

if (fj) {
                    (void) fclose(fj);
                    if ((fd = open(jname, O_RDONLY, 0)) < 0) {
                            fprintf(stderr, "%s: can't open() %s\n", prog, jname);
                            cleanup(1);
                    }
            }
            for (i = i0 = i1 = 0, dmax0 = dmax, xx = len0; ; i++) {
                    while (1) {
                            for (j = dx[dmax].ijmp; j >= 0 && dx[dmax].jp.x[j] >= xx; j--)
                                    ;
``` g_calloc readjmps

Table 1 (cont')

...readjmps

```
            if (j < 0 && dx[dmax].offset && fj) {
                (void) lseek(fd, dx[dmax].offset, 0);
                (void) read(fd, (char *)&dx[dmax].jp, sizeof(struct jmp));
                (void) read(fd, (char *)&dx[dmax].offset, sizeof(dx[dmax].offset));
                dx[dmax].ijmp = MAXJMP-1;
            }
            else
                break;
        }
        if (i >= JMPS) {
            fprintf(stderr, "%s: too many gaps in alignment\n", prog);
            cleanup(1);
        }
        if (j >= 0) {
            siz = dx[dmax].jp.n[j];
            xx = dx[dmax].jp.x[j];
            dmax += siz;
            if (siz < 0) {              /* gap in second seq */
                pp[1].n[i1] = -siz;
                xx += siz;
                /* id = xx - yy + len1 - 1
                */
                pp[1].x[i1] = xx - dmax + len1 - 1;
                gapy++;
                ngapy -= siz;
/* ignore MAXGAP when doing endgaps */
                siz = (-siz < MAXGAP || endgaps)? -siz : MAXGAP;
                i1++;
            }
            else if (siz > 0) {         /* gap in first seq */
                pp[0].n[i0] = siz;
                pp[0].x[i0] = xx;
                gapx++;
                ngapx += siz;
/* ignore MAXGAP when doing endgaps */
                siz = (siz < MAXGAP || endgaps)? siz : MAXGAP;
                i0++;
            }
        }
        else
            break;
    }

/* reverse the order of jmps
    */
    for (j = 0, i0--; j < i0; j++, i0--) {
        i = pp[0].n[j]; pp[0].n[j] = pp[0].n[i0]; pp[0].n[i0] = i;
        i = pp[0].x[j]; pp[0].x[j] = pp[0].x[i0]; pp[0].x[i0] = i;
    }
    for (j = 0, i1--; j < i1; j++, i1--) {
        i = pp[1].n[j]; pp[1].n[j] = pp[1].n[i1]; pp[1].n[i1] = i;
        i = pp[1].x[j]; pp[1].x[j] = pp[1].x[i1]; pp[1].x[i1] = i;
    }
    if (fd >= 0)
        (void) close(fd);
    if (fj) {
        (void) unlink(jname);
        fj = 0;
        offset = 0;
    }
}
```

Table 1 (cont')

```
/*
 * write a filled jmp struct offset of the prev one (if any): nw()
 */
writejmps(ix)                                                                   writejmps
        int     ix;
{
        char    *mktemp();

if (!fj) {
                if (mktemp(jname) < 0) {
                        fprintf(stderr, "%s: can't mktemp() %s\n", prog, jname);
                        cleanup(1);
                }
                if ((fj = fopen(jname, "w")) == 0) {
                        fprintf(stderr, "%s: can't write %s\n", prog, jname);
                        exit(1);
                }
        }
        (void) fwrite((char *)&dx[ix].jp, sizeof(struct jmp), 1, fj);
        (void) fwrite((char *)&dx[ix].offset, sizeof(dx[ix].offset), 1, fj);
}
```

TABLE 2

| PRO | XXXXXXXXXXXXXXX | (Length = 15 amino acids) |
|---|---|---|
| Comparison Protein | XXXXXYYYYYYY | (Length = 12 amino acids) |

% amino acid sequence identity = (the number of identically matching amino acid residues between the two polypeptide sequences as determined by ALIGN-2) divided by (the total number of amino acid residues of the PRO polypeptide) = 5 divided by 15 = 33.3%

TABLE 3

| PRO | XXXXXXXXXX | (Length = 10 amino acids) |
|---|---|---|
| Comparison Protein | XXXXXYYYYYYZZYZ | (Length = 15 amino acids) |

% amino acid sequence identity = (the number of identically matching amino acid residues between the two polypeptide sequences as determined by ALIGN-2) divided by (the total number of amino acid residues of the PRO polypeptide) = 5 divided by 10 = 50%

TABLE 4

| PRO-DNA | NNNNNNNNNNNNNN | (Length = 14 nucleotides) |
|---|---|---|
| Comparison DNA | NNNNNNLLLLLLLLLL | (Length = 16 nucleotides) |

% nucleic acid sequence identity = (the number of identically matching nucleotides between the two nucleic acid sequences as determined by ALIGN-2) divided by (the total number of nucleotides of the PRO-DNA nucleic acid sequence) = 6 divided by 14 = 42.9%

TABLE 5

| PRO-DNA | NNNNNNNNNNNN | (Length = 12 nucleotides) |
|---|---|---|
| Comparison DNA | NNNNLLLVV | (Length = 9 nucleotides) |

% nucleic acid sequence identity = (the number of identically matching nucleotides between the two nucleic acid sequences as determined by ALIGN-2) divided by (the total number of nucleotides of the PRO-DNA nucleic acid sequence) = 4 divided by 12 = 33.3%

II. Compositions and Methods of the Invention

A. Full-Length PRO Polypeptides

The present invention provides newly identified and isolated nucleotide sequences encoding polypeptides referred to in the present application as PRO polypeptides. In particular, cDNAs encoding various PRO polypeptides have been identified and isolated, as disclosed in further detail in the Examples below. It is noted that proteins produced in separate expression rounds may be given different PRO numbers but the UNQ number is unique for any given DNA and the encoded protein, and will not be changed. However, for sake of simplicity, in the present specification the protein encoded by the full length native nucleic acid molecules disclosed herein as well as all further native homologues and variants included in the foregoing definition of PRO, will be referred to as "PRO/number", regardless of their origin or mode of preparation.

As disclosed in the Examples below, various cDNA clones have been deposited with the ATCC. The actual nucleotide sequences of those clones can readily be determined by the skilled artisan by sequencing of the deposited clone using routine methods in the art. The predicted amino acid sequence can be determined from the nucleotide sequence using routine skill. For the PRO polypeptides and encoding nucleic acids described herein, Applicants have identified what is believed to be the reading frame best identifiable with the sequence information available at the time.

B. PRO Polypeptide Variants

In addition to the full-length native sequence PRO polypeptides described herein, it is contemplated that PRO variants can be prepared. PRO variants can be prepared by introducing appropriate nucleotide changes into the PRO DNA, and/or by synthesis of the desired PRO polypeptide. Those skilled in the art will appreciate that amino acid changes may alter post-translational processes of the PRO, such as changing the number or position of glycosylation sites or altering the membrane anchoring characteristics.

Variations in the native full-length sequence PRO or in various domains of the PRO described herein, can be made, for example, using any of the techniques and guidelines for conservative and non-conservative mutations set forth, for instance, in U.S. Pat. No. 5,364,934. Variations may be a substitution, deletion or insertion of one or more codons encoding the PRO that results in a change in the amino acid sequence of the PRO as compared with the native sequence PRO. Optionally the variation is by substitution of at least one amino acid with any other amino acid in one or more of the domains of the PRO. Guidance in determining which amino acid residue may be inserted, substituted or deleted without adversely affecting the desired activity may be found by comparing the sequence of the PRO with that of homologous known protein molecules and minimizing the number of amino acid sequence changes made in regions of high homology. Amino acid substitutions can be the result of replacing one amino acid with another amino acid having similar structural and/or chemical properties, such as the replacement of a leucine with a serine, i.e., conservative amino acid replacements. Insertions or deletions may optionally be in the range of about 1 to 5 amino acids. The variation allowed may be determined by systematically making insertions, deletions or substitutions of amino acids in the sequence and testing the resulting variants for activity exhibited by the full-length or mature native sequence.

PRO polypeptide fragments are provided herein. Such fragments may be truncated at the N-terminus or C-terminus, or may lack internal residues, for example, when compared with a full length native protein. Certain fragments lack amino acid residues that are not essential for a desired biological activity of the PRO polypeptide.

PRO fragments may be prepared by any of a number of conventional techniques. Desired peptide fragments may be chemically synthesized. An alternative approach involves generating PRO fragments by enzymatic digestion, e.g., by treating the protein with an enzyme known to cleave proteins at sites defined by particular amino acid residues, or by digesting the DNA with suitable restriction enzymes and isolating the desired fragment. Yet another suitable technique involves isolating and amplifying a DNA fragment encoding a desired polypeptide fragment, by polymerase chain reaction (PCR). Oligonucleotides that define the desired termini of the DNA fragment are employed at the 5' and 3' primers in the PCR. Preferably, PRO polypeptide fragments share at least one biological and/or immunological activity with the native PRO polypeptide disclosed herein.

In particular embodiments, conservative substitutions of interest are shown in Table 6 under the heading of preferred substitutions. If such substitutions result in a change in biological activity, then more substantial changes, denominated exemplary substitutions in Table 6, or as further described below in reference to amino acid classes, are introduced and the products screened.

TABLE 6

| Original Residue | Exemplary Substitutions | Preferred Substitutions |
|---|---|---|
| Ala (A) | val; leu; ile | val |
| Arg (R) | lys; gln; asn | lys |
| Asn (N) | gln; his; lys; arg | gln |
| Asp (D) | glu | glu |
| Cys (C) | ser | ser |
| Gln (Q) | asn | asn |
| Glu (E) | asp | asp |
| Gly (G) | pro; ala | ala |
| His (H) | asn; gln; lys; arg | arg |
| Ile (I) | leu; val; met; ala; phe; norleucine | leu |
| Leu (L) | norleucine; ile; val; met; ala; phe | ile |
| Lys (K) | arg; gln; asn | arg |
| Met (M) | leu; phe; ile | leu |
| Phe (F) | leu; val; ile; ala; tyr | leu |
| Pro (P) | ala | ala |
| Ser (S) | thr | thr |
| Thr (T) | ser | ser |
| Trp (W) | tyr; phe | tyr |
| Tyr (Y) | trp; phe; thr; ser | phe |
| Val (V) | ile; leu; met; phe; ala; norleucine | leu |

Substantial modifications in function or immunological identity of the PRO polypeptide are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties:
(1) hydrophobic: norleucine, met, ala, val, leu, ile;
(2) neutral hydrophilic: cys, ser, thr;
(3) acidic: asp, glu;
(4) basic: asn, gln, his, lys, arg;
(5) residues that influence chain orientation: gly, pro; and
(6) aromatic: trp, tyr, phe.

Non-conservative substitutions will entail exchanging a member of one of these classes for another class. Such substituted residues also may be introduced into the conservative substitution sites or, more preferably, into the remaining (non-conserved) sites.

The variations can be made using methods known in the art such as oligonucleotide-mediated (site-directed) mutagenesis, alanine scanning, and PCR mutagenesis. Site-directed mutagenesis [Carter et al., *Nucl. Acids Res.*, 13:4331 (1986); Zoller et al., *Nucl. Acids Res.*, 10:6487 (1987)], cassette mutagenesis [Wells et al., *Gene*, 34:315 (1985)], restriction selection mutagenesis [Wells et al., *Philos. Trans. R. Soc. London SerA*, 317:415 (1986)] or other known techniques can be performed on the cloned DNA to produce the PRO variant DNA.

Scanning amino acid analysis can also be employed to identify one or more amino acids along a contiguous sequence. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant [Cunningham and Wells, *Science*, 244: 1081-1085 (1989)]. Alanine is also typically preferred because it is the most common amino acid. Further, it is frequently found in both buried and exposed positions [Creighton, *The Proteins*, (W.H. Freeman & Co., N.Y.); Chothia, *J. Mol. Biol.,* 150:1 (1976)]. If alanine substitution does not yield adequate amounts of variant, an isoteric amino acid can be used.

C. Modifications of PRO

Covalent modifications of PRO are included within the scope of this invention. One type of covalent modification includes reacting targeted amino acid residues of a PRO polypeptide with an organic derivatizing agent that is capable of reacting with selected side chains or the N- or C-terminal residues of the PRO. Derivatization with bifunctional agents is useful, for instance, for crosslinking PRO to a water-insoluble support matrix or surface for use in the method for purifying anti-PRO antibodies, and vice-versa. Commonly used crosslinking agents include, e.g., 1,1-bis (diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), bifunctional maleimides such as bis-N-maleimido-1,8-octane and agents such as methyl-3-[(p-azidophenyl)dithio]propioimidate.

Other modifications include deamidation of glutaminyl and asparaginyl residues to the corresponding glutamyl and aspartyl residues, respectively, hydroxylation of proline and lysine, phosphorylation of hydroxyl groups of seryl or threonyl residues, methylation of the α-amino groups of lysine, arginine, and histidine side chains [T. E. Creighton, *Proteins: Structure and Molecular Properties*, W. H. Freeman & Co., San Francisco, pp. 79-86 (1983)], acetylation of the N-terminal amine, and amidation of any C-terminal carboxyl group.

Another type of covalent modification of the PRO polypeptide included within the scope of this invention comprises altering the native glycosylation pattern of the polypeptide. "Altering the native glycosylation pattern" is intended for purposes herein to mean deleting one or more carbohydrate moieties found in native sequence PRO (either by removing the underlying glycosylation site or by deleting the glycosylation by chemical and/or enzymatic means), and/or adding one or more glycosylation sites that are not present in the native sequence PRO. In addition, the phrase includes qualitative changes in the glycosylation of the native proteins, involving a change in the nature and proportions of the various carbohydrate moieties present.

Addition of glycosylation sites to the PRO polypeptide may be accomplished by altering the amino acid sequence. The alteration may be made, for example, by the addition of, or substitution by, one or more serine or threonine residues to the native sequence PRO (for O-linked glycosylation sites). The PRO amino acid sequence may optionally be altered through changes at the DNA level, particularly by mutating the DNA encoding the PRO polypeptide at preselected bases such that codons are generated that will translate into the desired amino acids.

Another means of increasing the number of carbohydrate moieties on the PRO polypeptide is by chemical or enzymatic coupling of glycosides to the polypeptide. Such methods are described in the art, e.g., in WO 87/05330 published 11 Sep. 1987, and in Aplin and Wriston, *CRC Crit. Rev. Biochem.*, pp. 259-306 (1981).

Removal of carbohydrate moieties present on the PRO polypeptide may be accomplished chemically or enzymatically or by mutational substitution of codons encoding for amino acid residues that serve as targets for glycosylation. Chemical deglycosylation techniques are known in the art and described, for instance, by Hakimuddin, et al., *Arch. Biochem. Biophys.*, 259:52 (1987) and by Edge et al., *Anal. Biochem.*, 118:131 (1981). Enzymatic cleavage of carbohydrate moieties on polypeptides can be achieved by the use of a variety of endo- and exo-glycosidases as described by Thotakura et al., *Meth. Enzymol.*, 138:350 (1987).

Another type of covalent modification of PRO comprises linking the PRO polypeptide to one of a variety of nonproteinaceous polymers, e.g., polyethylene glycol (PEG), polypropylene glycol, or polyoxyalkylenes, in the manner set forth in U.S. Pat. Nos. 4,640,835; 4,496,689; 4,301,144; 4,670,417; 4,791,192 or 4,179,337.

The PRO of the present invention may also be modified in a way to form a chimeric molecule comprising PRO fused to another, heterologous polypeptide or amino acid sequence.

In one embodiment, such a chimeric molecule comprises a fusion of the PRO with a tag polypeptide which provides an epitope to which an anti-tag antibody can selectively bind. The epitope tag is generally placed at the amino- or carboxyl-terminus of the PRO. The presence of such epitope-tagged forms of the PRO can be detected using an antibody against the tag polypeptide. Also, provision of the epitope tag enables the PRO to be readily purified by affinity purification using an anti-tag antibody or another type of affinity matrix that binds to the epitope tag. Various tag polypeptides and their respective antibodies are well known in the art. Examples include poly-histidine (poly-his) or poly-histidine-glycine (poly-his-gly) tags; the flu HA tag polypeptide and its antibody 12CA5 [Field et al., *Mol. Cell. Biol.*, 8:2159-2165 (1988)]; the c-myc tag and the 8F9, 3C7, 6E10, G4, B7 and 9E10 antibodies thereto [Evan et al., *Molecular and Cellular Biology*, 5:3610-3616 (1985)]; and the Herpes Simplex virus glycoprotein D (gD) tag and its antibody [Paborsky et al., *Protein Engineering*, 3(6):547-553 (1990)]. Other tag polypeptides include the Flag-peptide [Hopp et al., *BioTechnology*, 6:1204-1210 (1988)]; the KT3 epitope peptide [Martin et al., *Science*, 255:192-194 (1992)]; an α-tubulin epitope peptide [Skinner et al., *J. Biol. Chem.*, 266:15163-15166 (1991)]; and the T7 gene 10 protein peptide tag [Lutz-Freyermuth et al., *Proc. Natl. Acad. Sci. USA*, 87:6393-6397 (1990)].

In an alternative embodiment, the chimeric molecule may comprise a fusion of the PRO with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of a PRO polypeptide in place of at least one variable region within an Ig molecule. In a particularly preferred embodiment, the immunoglobulin fusion includes the hinge, CH2 and CH3, or the hinge, CH1, CH2 and CH3 regions of an IgG1 molecule. For the production of immunoglobulin fusions see also U.S. Pat. No. 5,428,130 issued Jun. 27, 1995.

D. Preparation of PRO

The description below relates primarily to production of PRO by culturing cells transformed or transfected with a vector containing PRO nucleic acid. It is, of course, contemplated that alternative methods, which are well known in the art, may be employed to prepare PRO. For instance, the PRO sequence, or portions thereof, may be produced by direct peptide synthesis using solid-phase techniques [see, e.g., Stewart et al., *Solid-Phase Peptide Synthesis*, W. H. Freeman Co., San Francisco, Calif. (1969); Merrifield, *J. Am. Chem. Soc.*, 85:2149-2154 (1963)]. In vitro protein synthesis may be performed using manual techniques or by automation. Automated synthesis may be accomplished, for instance, using an Applied Biosystems Peptide Synthesizer (Foster City, Calif.) using manufacturer's instructions. Various portions of the PRO may be chemically synthesized separately and combined using chemical or enzymatic methods to produce the full-length PRO.

1. Isolation of DNA Encoding PRO

DNA encoding PRO may be obtained from a cDNA library prepared from tissue believed to possess the PRO mRNA and to express it at a detectable level. Accordingly, human PRO DNA can be conveniently obtained from a cDNA library prepared from human tissue, such as described in the Examples. The PRO-encoding gene may also be obtained from a genomic library or by known synthetic procedures (e.g., automated nucleic acid synthesis).

Libraries can be screened with probes (such as antibodies to the PRO or oligonucleotides of at least about 20-80 bases) designed to identify the gene of interest or the protein encoded by it. Screening the cDNA or genomic library with the selected probe may be conducted using standard procedures, such as described in Sambrook et al., *Molecular Cloning: A Laboratory Manual* (New York: Cold Spring Harbor Laboratory Press, 1989). An alternative means to isolate the gene encoding PRO is to use PCR methodology [Sambrook et al., supra; Dieffenbach et al., *PCR Primer: A Laboratory Manual* (Cold Spring Harbor Laboratory Press, 1995)].

The Examples below describe techniques for screening a cDNA library. The oligonucleotide sequences selected as probes should be of sufficient length and sufficiently unambiguous that false positives are minimized. The oligonucleotide is preferably labeled such that it can be detected upon hybridization to DNA in the library being screened. Methods of labeling are well known in the art, and include the use of radiolabels like $^{32}$P-labeled ATP, biotinylation or enzyme labeling. Hybridization conditions, including moderate stringency and high stringency, are provided in Sambrook et al., supra.

Sequences identified in such library screening methods can be compared and aligned to other known sequences deposited and available in public databases such as GenBank or other private sequence databases. Sequence identity (at either the amino acid or nucleotide level) within defined regions of the molecule or across the full-length sequence can be determined using methods known in the art and as described herein.

Nucleic acid having protein coding sequence may be obtained by screening selected cDNA or genomic libraries using the deduced amino acid sequence disclosed herein for the first time, and, if necessary, using conventional primer extension procedures as described in Sambrook et al., supra, to detect precursors and processing intermediates of mRNA that may not have been reverse-transcribed into cDNA.

2. Selection and Transformation of Host Cells

Host cells are transfected or transformed with expression or cloning vectors described herein for PRO production and cultured in conventional nutrient media modified as appropriate for inducing promoters, selecting transformants, or amplifying the genes encoding the desired sequences. The culture conditions, such as media, temperature, pH and the like, can be selected by the skilled artisan without undue experimentation. In general, principles, protocols, and practical techniques for maximizing the productivity of cell cultures can be found in *Mammalian Cell Biotechnology: a Practical Approach*, M. Butler, ed. (IRL Press, 1991) and Sambrook et al., supra.

Methods of eukaryotic cell transfection and prokaryotic cell transformation are known to the ordinarily skilled artisan, for example, CaCl$_2$, CaPO$_4$, liposome-mediated and electroporation. Depending on the host cell used, transformation is performed using standard techniques appropriate to such cells. The calcium treatment employing calcium chloride, as described in Sambrook et al., supra, or electroporation is generally used for prokaryotes. Infection with *Agrobacterium tumefaciens* is used for transformation of certain plant cells, as described by Shaw et al., *Gene*, 23:315 (1983) and WO 89/05859 published Jun. 29, 1989. For mammalian cells without such cell walls, the calcium phosphate precipitation method of Graham and van der Eb, *Virology*, 52:456-457 (1978) can be employed. General aspects of mammalian cell host system transfections have been described in U.S. Pat. No. 4,399,216. Transformations into yeast are typically carried out according to the method of Van Solingen et al., *J. Bact.*, 130:946 (1977) and Hsiao et al., *Proc. Natl. Acad. Sci. (USA)*, 76:3829 (1979). However, other methods for introducing DNA into cells, such as by nuclear microinjection, electroporation, bacterial protoplast fusion with intact cells, or polycations, e.g., polybrene, polyornithine, may also be used. For various techniques for transforming mammalian cells, see Keown et al., *Methods in Enzymology*, 185:527-537 (1990) and Mansour et al., *Nature*, 336:348-352 (1988).

Suitable host cells for cloning or expressing the DNA in the vectors herein include prokaryote, yeast, or higher eukaryote cells. Suitable prokaryotes include but are not limited to eubacteria, such as Gram-negative or Gram-positive organisms, for example, Enterobacteriaceae such as *E. coli*. Various *E. coli* strains are publicly available, such as *E. coli* K12 strain MM294 (ATCC 31,446); *E. coli* X1776 (ATCC 31,537); *E. coli* strain W3110 (ATCC 27,325) and K5 772 (ATCC 53,635). Other suitable prokaryotic host cells include Enterobacteriaceae such as *Escherichia*, e.g., *E. coli, Enterobacter, Erwinia, Klebsiella, Proteus, Salmonella*, e.g., *Salmonella typhimurium, Serratia*, e.g., *Serratia marcescans*, and *Shigella*, as well as *Bacilli* such as *B. subtilis* and *B. licheniformis* (e.g., *B. licheniformis* 41P disclosed in DD 266,710 published 12 Apr. 1989), *Pseudomonas* such as *P. aeruginosa*, and *Streptomyces*. These examples are illustrative rather than limiting. Strain W3110 is one particularly preferred host or parent host because it is a common host strain for recombinant DNA product fermentations. Preferably, the host cell secretes minimal amounts of proteolytic enzymes. For example, strain W3110 may be modified to effect a genetic mutation in the genes encoding proteins endogenous to the host, with examples of such hosts including *E. coli* W3110 strain 1A2, which has the complete genotype tonA; *E. coli* W3110 strain 9E4, which has the complete genotype tonA ptr3; *E. coli* W3110 strain 27C7 (ATCC 55,244), which has the complete genotype tonA ptr3 phoA E15 (argF-lac)169 degP ompT kan$^r$; *E. coli* W3110 strain 37D6, which has the complete genotype tonA ptr3 phoA E15 (argF-lac)169 degP ompT rbs7 ilvG kan$^r$; *E. coli* W3110 strain 40B4, which is strain 37D6 with a non-kanamycin resistant degP deletion mutation; and an *E. coli* strain having mutant periplasmic protease disclosed in U.S. Pat. No. 4,946,783 issued 7 Aug. 1990. Alternatively, in vitro methods of cloning, e.g., PCR or other nucleic acid polymerase reactions, are suitable.

In addition to prokaryotes, eukaryotic microbes such as filamentous fungi or yeast are suitable cloning or expression hosts for PRO-encoding vectors. *Saccharomyces cerevisiae* is a commonly used lower eukaryotic host microorganism. Others include *Schizosaccharomyces pombe* (Beach and Nurse, *Nature*, 290: 140 [1981]; EP 139,383 published 2 May 1985); *Kluyveromyces* hosts (U.S. Pat. No. 4,943,529; Fleer et al., *Bio/Technology*, 9:968-975 (1991)) such as, e.g., *K. lactis* (MW98-8C, CBS683, CBS4574; Louvencourt et al., *J. Bacteriol.*, 154(2):737-742 [1983]), *K. fragilis* (ATCC 12,424), *K. bulgaricus* (ATCC 16,045), *K. wickeramii* (ATCC 24,178), *K. waltii* (ATCC 56,500), *K. drosophilarum* (ATCC 36,906; Van den Berg et al., *Bio/Technology*, 8:135 (1990)), *K. thermotolerans*, and *K. marxianus; yarrowia* (EP 402,226); *Pichia pastoris* (EP 183,070; Sreekrishna et al., *J. Basic Microbiol.*, 28:265-278 [1988]); *Candida; Trichoderma reesia* (EP 244,234); *Neurospora crassa* (Case et af., *Proc. Natl. Acad. Sci. USA*, 76:5259-5263 [1979]); *Schwanniomyces* such as *Schwanniomyces occidentalis* (EP 394,538 published 31 Oct. 1990); and filamentous fungi such as, e.g., *Neurospora, Penicillium, Tolypocladium* (WO 91/00357 published Jan. 10, 1991), and *Aspergillus* hosts such as *A. nidulans* (Ballance et al., *Biochem. Biophys. Res. Commun.*, 112:284-289 [1983]; Tilburn et al., *Gene*, 26:205-221 [1983]; Yelton et al., *Proc. Natl. Acad. Sci. USA*, 81: 1470-1474 [1984]) and *A. niger* (Kelly and Hynes, *EMBO J.*, 4:475-479 [1985]). Methylotropic yeasts are suitable herein and include, but are not limited to, yeast capable of growth on methanol selected from the genera consisting of *Hansenula, Candida, Kloeckera, Pichia, Saccharomyces, Torulopsis*, and *Rhodotorula*. A list of specific species that are exemplary of this class of yeasts may be found in C. Anthony, *The Biochemistry of Methylotrophs*, 269 (1982).

Suitable host cells for the expression of glycosylated PRO are derived from multicellular organisms. Examples of invertebrate cells include insect cells such as *Drosophila* S2 and *Spodoptera* Sf9, as well as plant cells. Examples of useful mammalian host cell lines include Chinese hamster ovary (CHO) and COS cells. More specific examples include monkey kidney CV1 line transformed by SV40 (COS-7, ATCC CRL 1651); human embryonic kidney line (293 or 293 cells subcloned for growth in suspension culture, Graham et al., *J. Gen Virol.*, 36:59 (1977)); Chinese hamster ovary cells/-DHFR (CHO, Urlaub and Chasin, *Proc. Natl. Acad. Sci. USA*, 77:4216 (1980)); mouse sertoli cells (TM4, Mather, *Biol. Reprod.*, 23:243-251 (1980)); human lung cells (W138, ATCC CCL 75); human liver cells (Hep G2, HB 8065); and mouse mammary tumor (MMT 060562, ATCC CCL51). The selection of the appropriate host cell is deemed to be within the skill in the art.

3. Selection and Use of a Replicable Vector

The nucleic acid (e.g., cDNA or genomic DNA) encoding PRO may be inserted into a replicable vector for cloning (amplification of the DNA) or for expression. Various vectors are publicly available. The vector may, for example, be in the form of a plasmid, cosmid, viral particle, or phage. The appropriate nucleic acid sequence may be inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan.

The PRO may be produced recombinantly not only directly, but also as a fusion polypeptide with a heterologous polypeptide, which may be a signal sequence or other polypeptide having a specific cleavage site at the N-terminus of the mature protein or polypeptide. In general, the signal sequence may be a component of the vector, or it may be a part of the PRO-encoding DNA that is inserted into the vector. The signal sequence may be a prokaryotic signal sequence selected, for example, from the group of the alkaline phosphatase, penicillinase, 1pp, or heat-stable enterotoxin II leaders. For yeast secretion the signal sequence may be, e.g., the yeast invertase leader, alpha factor leader (including *Saccharomyces* and *Kluyveromyces* α-factor leaders, the latter described in U.S. Pat. No. 5,010, 182), or acid phosphatase leader, the *C. albicans* glucoamylase leader (EP 362,179 published 4 Apr. 1990), or the signal described in WO 90/13646 published 15 Nov. 1990. In mammalian cell expression, mammalian signal sequences may be used to direct secretion of the protein, such as signal sequences from secreted polypeptides of the same or related species, as well as viral secretory leaders.

Both expression and cloning vectors contain a nucleic acid sequence that enables the vector to replicate in one or more selected host cells. Such sequences are well known for a variety of bacteria, yeast, and viruses. The origin of replication from the plasmid pBR322 is suitable for most Gram-negative bacteria, the 2µ plasmid origin is suitable for yeast, and various viral origins (SV40, polyoma, adenovirus, VSV or BPV) are useful for cloning vectors in mammalian cells.

Expression and cloning vectors will typically contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for *Bacilli*.

An example of suitable selectable markers for mammalian cells are those that enable the identification of cells competent to take up the PRO-encoding nucleic acid, such as DHFR or thymidine kinase. An appropriate host cell when wild-type DHFR is employed is the CHO cell line deficient in DHFR activity, prepared and propagated as described by Urlaub et al., *Proc. Natl. Acad. Sci. USA,* 77:4216 (1980). A suitable selection gene for use in yeast is the trp1 gene present in the yeast plasmid YRp7 [Stinchcomb et al., *Nature,* 282:39 (1979); Kingsman et al., *Gene,* 7:141 (1979); Tschemper et al., *Gene,* 10:157 (1980)]. The trp1 gene provides a selection marker for a mutant strain of yeast lacking the ability to grow in tryptophan, for example, ATCC No. 44076 or PEP4-1 [Jones, *Genetics,* 85:12 (1977)].

Expression and cloning vectors usually contain a promoter operably linked to the PRO-encoding nucleic acid sequence to direct mRNA synthesis. Promoters recognized by a variety of potential host cells are well known. Promoters suitable for use with prokaryotic hosts include the β-lactamase and lactose promoter systems [Chang et al., *Nature,* 275:615 (1978); Goeddel et al., *Nature,* 281:544 (1979)], alkaline phosphatase, a tryptophan (trp) promoter system [Goeddel, *Nucleic Acids Res.,* 8:4057 (1980); EP 36,776], and hybrid promoters such as the tac promoter [deBoer et al., *Proc. Natl. Acad. Sci. USA,* 80:21-25 (1983)]. Promoters for use in bacterial systems also will contain a Shine-Dalgarno (S.D.) sequence operably linked to the DNA encoding PRO.

Examples of suitable promoting sequences for use with yeast hosts include the promoters for 3-phosphoglycerate kinase [Hitzeman et al., *J. Biol. Chem.,* 255:2073 (1980)] or other glycolytic enzymes [Hess et al., *J. Adv. Enzyme Reg.,* 7:149 (1968); Holland, *Biochemistry,* 17:4900 (1978)], such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase.

Other yeast promoters, which are inducible promoters having the additional advantage of transcription controlled by growth conditions, are the promoter regions for alcohol dehydrogenase 2, isocytochrome C, acid phosphatase, degradative enzymes associated with nitrogen metabolism, metallothionein, glyceraldehyde-3-phosphate dehydrogenase, and enzymes responsible for maltose and galactose utilization. Suitable vectors and promoters for use in yeast expression are further described in EP 73,657.

PRO transcription from vectors in mammalian host cells is controlled, for example, by promoters obtained from the genomes of viruses such as polyoma virus, fowlpox virus (UK 2,211,504 published 5 Jul. 1989), adenovirus (such as Adenovirus 2), bovine papilloma virus, avian sarcoma virus, cytomegalovirus, a retrovirus, hepatitis-B virus and Simian Virus 40 (SV40), from heterologous mammalian promoters, e.g., the actin promoter or an immunoglobulin promoter, and from heat-shock promoters, provided such promoters are compatible with the host cell systems.

Transcription of a DNA encoding the PRO by higher eukaryotes may be increased by inserting an enhancer sequence into the vector. Enhancers are cis-acting elements of DNA, usually about from 10 to 300 bp, that act on a promoter to increase its transcription. Many enhancer sequences are now known from mammalian genes (globin, elastase, albumin, α-fetoprotein, and insulin). Typically, however, one will use an enhancer from a eukaryotic cell virus. Examples include the SV40 enhancer on the late side of the replication origin (bp 100-270), the cytomegalovirus early promoter enhancer, the polyoma enhancer on the late side of the replication origin, and adenovirus enhancers. The enhancer may be spliced into the vector at a position 5' or 3' to the PRO coding sequence, but is preferably located at a site 5' from the promoter.

Expression vectors used in eukaryotic host cells (yeast, fungi, insect, plant, animal, human, or nucleated cells from other multicellular organisms) will also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding PRO.

Still other methods, vectors, and host cells suitable for adaptation to the synthesis of PRO in recombinant vertebrate cell culture are described in Gething et al., *Nature,* 293:620-625 (1981); Mantei et al., *Nature,* 281:40-46 (1979); EP 117,060; and EP 117,058.

4. Detecting Gene Amplification/Expression

Gene amplification and/or expression may be measured in a sample directly, for example, by conventional Southern blotting, Northern blotting to quantitate the transcription of mRNA [Thomas, *Proc. Natl. Acad. Sci. USA,* 77:5201-5205 (1980)], dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes. The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological methods, such as immunohistochemical staining of cells or tissue sections and assay of cell culture or body fluids, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native sequence PRO polypeptide or against a synthetic peptide based on the DNA sequences provided herein or against exogenous sequence fused to PRO DNA and encoding a specific antibody epitope.

5. Purification of Polypeptide

Forms of PRO may be recovered from culture medium or from host cell lysates. If membrane-bound, it can be released from the membrane using a suitable detergent solution (e.g. Triton-X 100) or by enzymatic cleavage. Cells employed in expression of PRO can be disrupted by various physical or chemical means, such as freeze-thaw cycling, sonication, mechanical disruption, or cell lysing agents.

It may be desired to purify PRO from recombinant cell proteins or polypeptides. The following procedures are exemplary of suitable purification procedures: by fractionation on an ion-exchange column; ethanol precipitation; reverse phase HPLC; chromatography on silica or on a cation-exchange resin such as DEAE; chromatofocusing; SDS-PAGE; ammonium sulfate precipitation; gel filtration using, for example, Sephadex G-75; protein A Sepharose columns to remove contaminants such as IgG; and metal chelating columns to bind epitope-tagged forms of the PRO. Various methods of protein purification may be employed and such methods are known in the art and described for example in Deutscher, *Methods in Enzymology*, 182 (1990); Scopes, *Protein Purification: Principles and Practice*, Springer-Verlag, New York (1982). The purification step(s) selected will depend, for example, on the nature of the production process used and the particular PRO produced.

E. Uses for PRO

Nucleotide sequences (or their complement) encoding PRO have various applications in the art of molecular biology, including uses as hybridization probes, in chromosome and gene mapping and in the generation of anti-sense RNA and DNA. PRO nucleic acid will also be useful for the preparation of PRO polypeptides by the recombinant techniques described herein.

The full-length native sequence PRO gene, or portions thereof, may be used as hybridization probes for a cDNA library to isolate the full-length PRO cDNA or to isolate still other cDNAs (for instance, those encoding naturally-occurring variants of PRO or PRO from other species) which have a desired sequence identity to the native PRO sequence disclosed herein. Optionally, the length of the probes will be about 20 to about 50 bases. The hybridization probes may be derived from at least partially novel regions of the full length native nucleotide sequence wherein those regions may be determined without undue experimentation or from genomic sequences including promoters, enhancer elements and introns of native sequence PRO. By way of example, a screening method will comprise isolating the coding region of the PRO gene using the known DNA sequence to synthesize a selected probe of about 40 bases. Hybridization probes may be labeled by a variety of labels, including radionucleotides such as $^{32}P$ or $^{35}S$, or enzymatic labels such as alkaline phosphatase coupled to the probe via avidin/biotin coupling systems. Labeled probes having a sequence complementary to that of the PRO gene of the present invention can be used to screen libraries of human cDNA, genomic DNA or mRNA to determine which members of such libraries the probe hybridizes to. Hybridization techniques are described in further detail in the Examples below.

Any EST sequences disclosed in the present application may similarly be employed as probes, using the methods disclosed herein.

Other useful fragments of the PRO nucleic acids include antisense or sense oligonucleotides comprising a singe-stranded nucleic acid sequence (either RNA or DNA) capable of binding to target PRO mRNA (sense) or PRO DNA (antisense) sequences. Antisense or sense oligonucleotides, according to the present invention, comprise a fragment of the coding region of PRO DNA. Such a fragment generally comprises at least about 14 nucleotides, preferably from about 14 to 30 nucleotides. The ability to derive an antisense or a sense oligonucleotide, based upon a cDNA sequence encoding a given protein is described in, for example, Stein and Cohen (*Cancer Res.* 48:2659, 1988) and van der Krol et al. (*BioTechniques* 6:958, 1988).

Binding of antisense or sense oligonucleotides to target nucleic acid sequences results in the formation of duplexes that block transcription or translation of the target sequence by one of several means, including enhanced degradation of the duplexes, premature termination of transcription or translation, or by other means. The antisense oligonucleotides thus may be used to block expression of PRO proteins. Antisense or sense oligonucleotides further comprise oligonucleotides having modified sugar-phosphodiester backbones (or other sugar linkages, such as those described in WO 91/06629) and wherein such sugar linkages are resistant to endogenous nucleases. Such oligonucleotides with resistant sugar linkages are stable in vivo (i.e., capable of resisting enzymatic degradation) but retain sequence specificity to be able to bind to target nucleotide sequences.

Other examples of sense or antisense oligonucleotides include those oligonucleotides which are covalently linked to organic moieties, such as those described in WO 90/10048, and other moieties that increases affinity of the oligonucleotide for a target nucleic acid sequence, such as poly-(L-lysine). Further still, intercalating agents, such as ellipticine, and alkylating agents or metal complexes may be attached to sense or antisense oligonucleotides to modify binding specificities of the antisense or sense oligonucleotide for the target nucleotide sequence.

Antisense or sense oligonucleotides may be introduced into a cell containing the target nucleic acid sequence by any gene transfer method, including, for example, $CaPO_4$-mediated DNA transfection, electroporation, or by using gene transfer vectors such as Epstein-Barr virus. In a preferred procedure, an antisense or sense oligonucleotide is inserted into a suitable retroviral vector. A cell containing the target nucleic acid sequence is contacted with the recombinant retroviral vector, either in vivo or ex vivo. Suitable retroviral vectors include, but are not limited to, those derived from the murine retrovirus M-MuLV, N2 (a retrovirus derived from M-MuLV), or the double copy vectors designated DCT5A, DCT5B and DCT5C (see WO 90/13641).

Sense or antisense oligonucleotides also may be introduced into a cell containing the target nucleotide sequence by formation of a conjugate with a ligand binding molecule, as described in WO 91/04753. Suitable ligand binding molecules include, but are not limited to, cell surface receptors, growth factors, other cytokines, or other ligands that bind to cell surface receptors. Preferably, conjugation of the ligand binding molecule does not substantially interfere with the ability of the ligand binding molecule to bind to its corresponding molecule or receptor, or block entry of the sense or antisense oligonucleotide or its conjugated version into the cell.

Alternatively, a sense or an antisense oligonucleotide may be introduced into a cell containing the target nucleic acid sequence by formation of an oligonucleotide-lipid complex, as described in WO 90/10448. The sense or antisense oligonucleotide-lipid complex is preferably dissociated within the cell by an endogenous lipase.

Antisense or sense RNA or DNA molecules are generally at least about 5 bases in length, about 10 bases in length, about 15 bases in length, about 20 bases in length, about 25 bases in length, about 30 bases in length, about 35 bases in length, about 40 bases in length, about 45 bases in length, about 50 bases in length, about 55 bases in length, about 60 bases in length, about 65 bases in length, about 70 bases in length, about 75 bases in length, about 80 bases in length, about 85 bases in length, about 90 bases in length, about 95 bases in length, about 100 bases in length, or more.

The probes may also be employed in PCR techniques to generate a pool of sequences for identification of closely related PRO coding sequences.

Nucleotide sequences encoding a PRO can also be used to construct hybridization probes for mapping the gene which encodes that PRO and for the genetic analysis of individuals with genetic disorders. The nucleotide sequences provided herein may be mapped to a chromosome and specific regions of a chromosome using known techniques, such as in situ hybridization, linkage analysis against known chromosomal markers, and hybridization screening with libraries.

When the coding sequences for PRO encode a protein which binds to another protein (example, where the PRO is a receptor), the PRO can be used in assays to identify the other proteins or molecules involved in the binding interaction. By such methods, inhibitors of the receptor/ligand binding interaction can be identified. Proteins involved in such binding interactions can also be used to screen for peptide or small molecule inhibitors or agonists of the binding interaction. Also, the receptor PRO can be used to isolate correlative ligand(s). Screening assays can be designed to find lead compounds that mimic the biological activity of a native PRO or a receptor for PRO. Such screening assays will include assays amenable to high-throughput screening of chemical libraries, making them particularly suitable for identifying small molecule drug candidates. Small molecules contemplated include synthetic organic or inorganic compounds. The assays can be performed in a variety of formats, including protein-protein binding assays, biochemical screening assays, immunoassays and cell based assays, which are well characterized in the art.

Nucleic acids which encode PRO or its modified forms can also be used to generate either transgenic animals or "knock out" animals which, in turn, are useful in the development and screening of therapeutically useful reagents. A transgenic animal (e.g., a mouse or rat) is an animal having cells that contain a transgene, which transgene was introduced into the animal or an ancestor of the animal at a prenatal, e.g., an embryonic stage. A transgene is a DNA which is integrated into the genome of a cell from which a transgenic animal develops. In one embodiment, cDNA encoding PRO can be used to clone genomic DNA encoding PRO in accordance with established techniques and the genomic sequences used to generate transgenic animals that contain cells which express DNA encoding PRO. Methods for generating transgenic animals, particularly animals such as mice or rats, have become conventional in the art and are described, for example, in U.S. Pat. Nos. 4,736,866 and 4,870,009. Typically, particular cells would be targeted for PRO transgene incorporation with tissue-specific enhancers. Transgenic animals that include a copy of a transgene encoding PRO introduced into the germ line of the animal at an embryonic stage can be used to examine the effect of increased expression of DNA encoding PRO. Such animals can be used as tester animals for reagents thought to confer protection from, for example, pathological conditions associated with its overexpression. In accordance with this facet of the invention, an animal is treated with the reagent and a reduced incidence of the pathological condition, compared to untreated animals bearing the transgene, would indicate a potential therapeutic intervention for the pathological condition.

Alternatively, non-human homologues of PRO can be used to construct a PRO "knock out" animal which has a defective or altered gene encoding PRO as a result of homologous recombination between the endogenous gene encoding PRO and altered genomic DNA encoding PRO introduced into an embryonic stem cell of the animal. For example, cDNA encoding PRO can be used to clone genomic DNA encoding PRO in accordance with established techniques. A portion of the genomic DNA encoding PRO can be deleted or replaced with another gene, such as a gene encoding a selectable marker which can be used to monitor integration. Typically, several kilobases of unaltered flanking DNA (both at the 5' and 3' ends) are included in the vector [see e.g., Thomas and Capecchi, *Cell,* 51:503 (1987) for a description of homologous recombination vectors]. The vector is introduced into an embryonic stem cell line (e.g., by electroporation) and cells in which the introduced DNA has homologously recombined with the endogenous DNA are selected [see e.g., Li et al., *Cell,* 69:915 (1992)]. The selected cells are then injected into a blastocyst of an animal (e.g., a mouse or rat) to form aggregation chimeras [see e.g., Bradley, in *Teratocarcinomas and Embryonic Stem Cells: A Practical Approach*, E. J. Robertson, ed. (IRL, Oxford, 1987), pp. 113-152]. A chimeric embryo can then be implanted into a suitable pseudopregnant female foster animal and the embryo brought to term to create a "knock out" animal. Progeny harboring the homologously recombined DNA in their germ cells can be identified by standard techniques and used to breed animals in which all cells of the animal contain the homologously recombined DNA. Knock-out animals can be characterized for instance, for their ability to defend against certain pathological conditions and for their development of pathological conditions due to absence of the PRO polypeptide.

Nucleic acid encoding the PRO polypeptides may also be used in gene therapy. In gene therapy applications, genes are introduced into cells in order to achieve in vivo synthesis of a therapeutically effective genetic product, for example for replacement of a defective gene. "Gene therapy" includes both conventional gene therapy where a lasting effect is achieved by a single treatment, and the administration of gene therapeutic agents, which involves the one time or repeated administration of a therapeutically effective DNA or mRNA. Antisense RNAs and DNAs can be used as therapeutic agents for blocking the expression of certain genes in vivo. It has already been shown that short antisense oligonucleotides can be imported into cells where they act as inhibitors, despite their low intracellular concentrations caused by their restricted uptake by the cell membrane.

(Zamecnik et al., *Proc. Natl. Acad. Sci. USA* 83:4143-4146 [1986]). The oligonucleotides can be modified to enhance their uptake, e.g. by substituting their negatively charged phosphodiester groups by uncharged groups.

There are a variety of techniques available for introducing nucleic acids into viable cells. The techniques vary depending upon whether the nucleic acid is transferred into cultured cells in vitro, or in vivo in the cells of the intended host. Techniques suitable for the transfer of nucleic acid into mammalian cells in vitro include the use of liposomes, electroporation, microinjection, cell fusion, DEAE-dextran, the calcium phosphate precipitation method, etc. The currently preferred in vivo gene transfer techniques include transfection with viral (typically retroviral) vectors and viral coat protein-liposome mediated transfection (Dzau et al., *Trends in Biotechnology* 11, 205-210 [1993]). In some situations it is desirable to provide the nucleic acid source with an agent that targets the target cells, such as an antibody specific for a cell surface membrane protein or the target cell, a ligand for a receptor on the target cell, etc. Where liposomes are employed, proteins which bind to a cell surface membrane protein associated with endocytosis may be used for targeting and/or to facilitate uptake, e.g. capsid proteins or fragments thereof tropic for a particular cell type, antibodies for proteins which undergo internalization in cycling, proteins that target intracellular localization and enhance intracellular half-life. The technique of receptor-mediated endocytosis is described, for example, by Wu et al., *J. Biol. Chem.* 262, 4429-4432 (1987); and Wagner et al., *Proc. Natl. Acad. Sci. USA* 87, 3410-3414 (1990). For review of gene marking and gene therapy protocols see Anderson et al., *Science* 256, 808-813 (1992).

The PRO polypeptides described herein may also be employed as molecular weight markers for protein electrophoresis purposes and the isolated nucleic acid sequences may be used for recombinantly expressing those markers.

The nucleic acid molecules encoding the PRO polypeptides or fragments thereof described herein are useful for chromosome identification. In this regard, there exists an ongoing need to identify new chromosome markers, since relatively few chromosome marking reagents, based upon actual sequence data are presently available. Each PRO nucleic acid molecule of the present invention can be used as a chromosome marker.

The PRO polypeptides and nucleic acid molecules of the present invention may also be used diagnostically for tissue typing, wherein the PRO polypeptides of the present invention may be differentially expressed in one tissue as compared to another, preferably in a diseased tissue as compared to a normal tissue of the same tissue type. PRO nucleic acid molecules will find use for generating probes for PCR, Northern analysis, Southern analysis and Western analysis.

The PRO polypeptides described herein may also be employed as therapeutic agents. The PRO polypeptides of the present invention can be formulated according to known methods to prepare pharmaceutically useful compositions, whereby the PRO product hereof is combined in admixture with a pharmaceutically acceptable carrier vehicle. Therapeutic formulations are prepared for storage by mixing the active ingredient having the desired degree of purity with optional physiologically acceptable carriers, excipients or stabilizers (*Remington's Pharmaceutical Sciences* 16th edition, Osol, A. Ed. (1980)), in the form of lyophilized formulations or aqueous solutions. Acceptable carriers, excipients or stabilizers are nontoxic to recipients at the dosages and concentrations employed, and include buffers such as phosphate, citrate and other organic acids; antioxidants including ascorbic acid; low molecular weight (less than about 10 residues) polypeptides; proteins, such as serum albumin, gelatin or immunoglobulins; hydrophilic polymers such as polyvinylpyrrolidone, amino acids such as glycine, glutamine, asparagine, arginine or lysine; monosaccharides, disaccharides and other carbohydrates including glucose, mannose, or dextrins; chelating agents such as EDTA; sugar alcohols such as mannitol or sorbitol; salt-forming counterions such as sodium; and/or nonionic surfactants such as TWEEN™, PLURONICS™ or PEG.

The formulations to be used for in vivo administration must be sterile. This is readily accomplished by filtration through sterile filtration membranes, prior to or following lyophilization and reconstitution.

Therapeutic compositions herein generally are placed into a container having a sterile access port, for example, an intravenous solution bag or vial having a stopper pierceable by a hypodermic injection needle.

The route of administration is in accord with known methods, e.g. injection or infusion by intravenous, intraperitoneal, intracerebral, intramuscular, intraocular, intraarterial or intralesional routes, topical administration, or by sustained release systems.

Dosages and desired drug concentrations of pharmaceutical compositions of the present invention may vary depending on the particular use envisioned. The determination of the appropriate dosage or route of administration is well within the skill of an ordinary physician. Animal experiments provide reliable guidance for the determination of effective doses for human therapy. Interspecies scaling of effective doses can be performed following the principles laid down by Mordenti, J. and Chappell, W. "The use of interspecies scaling in toxicokinetics" In Toxicokinetics and New Drug Development, Yacobi et al., Eds., Pergamon Press, New York 1989, pp. 42-96.

When in vivo administration of a PRO polypeptide or agonist or antagonist thereof is employed, normal dosage amounts may vary from about 10 ng/kg to up to 100 mg/kg of mammal body weight or more per day, preferably about 1 µg/kg/day to 10 mg/kg/day, depending upon the route of administration. Guidance as to particular dosages and methods of delivery is provided in the literature; see, for example, U.S. Pat. Nos. 4,657,760; 5,206,344; or 5,225,212. It is anticipated that different formulations will be effective for different treatment compounds and different disorders, that administration targeting one organ or tissue, for example, may necessitate delivery in a manner different from that to another organ or tissue.

Where sustained-release administration of a PRO polypeptide is desired in a formulation with release characteristics suitable for the treatment of any disease or disorder requiring administration of the PRO polypeptide, microencapsulation of the PRO polypeptide is contemplated. Microencapsulation of recombinant proteins for sustained release has been successfully performed with human growth hormone (rhGH), interferon-(rhIFN-), interleukin-2, and MN rgp120. Johnson et al., *Nat. Med.*, 2:795-799 (1996); Yasuda, *Biomed. Ther.*, 27:1221-1223 (1993); Hora et al., *Bio/Technology*, 8:755-758 (1990); Cleland, "Design and Production of Single Immunization Vaccines Using Polylactide Polyglycolide Microsphere Systems," in *Vaccine Design: The Subunit and Adjuvant Approach*, Powell and Newman, eds, (Plenum Press: New York, 1995), pp. 439-462; WO 97/03692, WO 96/40072, WO 96/07399; and U.S. Pat. No. 5,654,010.

The sustained-release formulations of these proteins were developed using poly-lactic-coglycolic acid (PLGA) polymer due to its biocompatibility and wide range of biodegradable properties. The degradation products of PLGA, lactic and glycolic acids, can be cleared quickly within the human body. Moreover, the degradability of this polymer can be adjusted from months to years depending on its molecular weight and composition. Lewis, "Controlled release of bioactive agents from lactide/glycolide polymer," in: M. Chasin and R. Langer (Eds.), *Biodegradable Polymers as Drug Delivery Systems* (Marcel Dekker: New York, 1990), pp. 1-41.

This invention encompasses methods of screening compounds to identify those that mimic the PRO polypeptide (agonists) or prevent the effect of the PRO polypeptide (antagonists). Screening assays for antagonist drug candidates are designed to identify compounds that bind or complex with the PRO polypeptides encoded by the genes identified herein, or otherwise interfere with the interaction of the encoded polypeptides with other cellular proteins. Such screening assays will include assays amenable to high-throughput screening of chemical libraries, making them particularly suitable for identifying small molecule drug candidates.

The assays can be performed in a variety of formats, including protein-protein binding assays, biochemical screening assays, immunoassays, and cell-based assays, which are well characterized in the art.

All assays for antagonists are common in that they call for contacting the drug candidate with a PRO polypeptide encoded by a nucleic acid identified herein under conditions and for a time sufficient to allow these two components to interact.

In binding assays, the interaction is binding and the complex formed can be isolated or detected in the reaction mixture. In a particular embodiment, the PRO polypeptide encoded by the gene identified herein or the drug candidate is immobilized on a solid phase, e.g., on a microtiter plate, by covalent or non-covalent attachments. Non-covalent attachment generally is accomplished by coating the solid surface with a solution of the PRO polypeptide and drying. Alternatively, an immobilized antibody, e.g., a monoclonal antibody, specific for the PRO polypeptide to be immobilized can be used to anchor it to a solid surface. The assay is performed by adding the non-immobilized component, which may be labeled by a detectable label, to the immobilized component, e.g., the coated surface containing the anchored component. When the reaction is complete, the non-reacted components are removed, e.g., by washing, and complexes anchored on the solid surface are detected. When the originally non-immobilized component carries a detectable label, the detection of label immobilized on the surface indicates that complexing occurred. Where the originally non-immobilized component does not carry a label, complexing can be detected, for example, by using a labeled antibody specifically binding the immobilized complex.

If the candidate compound interacts with but does not bind to a particular PRO polypeptide encoded by a gene identified herein, its interaction with that polypeptide can be assayed by methods well known for detecting protein-protein interactions. Such assays include traditional approaches, such as, e.g., cross-linking, co-immunoprecipitation, and co-purification through gradients or chromatographic columns. In addition, protein-protein interactions can be monitored by using a yeast-based genetic system described by Fields and co-workers (Fields and Song, *Nature* (*London*), 340:245-246 (1989); Chien et al., *Proc. Natl. Acad. Sci. USA*, 88:9578-9582 (1991)) as disclosed by Chevray and Nathans, *Proc. Natl. Acad. Sci. USA*, 89: 5789-5793 (1991). Many transcriptional activators, such as yeast GAL4, consist of two physically discrete modular domains, one acting as the DNA-binding domain, the other one functioning as the transcription-activation domain. The yeast expression system described in the foregoing publications (generally referred to as the "two-hybrid system") takes advantage of this property, and employs two hybrid proteins, one in which the target protein is fused to the DNA-binding domain of GAL4, and another, in which candidate activating proteins are fused to the activation domain. The expression of a GAL1-lacZ reporter gene under control of a GAL4-activated promoter depends on reconstitution of GAL4 activity via protein-protein interaction. Colonies containing interacting polypeptides are detected with a chromogenic substrate for β-galactosidase. A complete kit (MATCHMAKER™) for identifying protein-protein interactions between two specific proteins using the two-hybrid technique is commercially available from Clontech. This system can also be extended to map protein domains involved in specific protein interactions as well as to pinpoint amino acid residues that are crucial for these interactions.

Compounds that interfere with the interaction of a gene encoding a PRO polypeptide identified herein and other intra- or extracellular components can be tested as follows: usually a reaction mixture is prepared containing the product of the gene and the intra- or extracellular component under conditions and for a time allowing for the interaction and binding of the two products. To test the ability of a candidate compound to inhibit binding, the reaction is run in the absence and in the presence of the test compound. In addition, a placebo may be added to a third reaction mixture, to serve as positive control. The binding (complex formation) between the test compound and the intra- or extracellular component present in the mixture is monitored as described hereinabove. The formation of a complex in the control reaction(s) but not in the reaction mixture containing the test compound indicates that the test compound interferes with the interaction of the test compound and its reaction partner.

To assay for antagonists, the PRO polypeptide may be added to a cell along with the compound to be screened for a particular activity and the ability of the compound to inhibit the activity of interest in the presence of the PRO polypeptide indicates that the compound is an antagonist to the PRO polypeptide. Alternatively, antagonists may be detected by combining the PRO polypeptide and a potential antagonist with membrane-bound PRO polypeptide receptors or recombinant receptors under appropriate conditions for a competitive inhibition assay. The PRO polypeptide can be labeled, such as by radioactivity, such that the number of PRO polypeptide molecules bound to the receptor can be used to determine the effectiveness of the potential antagonist. The gene encoding the receptor can be identified by numerous methods known to those of skill in the art, for example, ligand panning and FACS sorting. Coligan et al., *Current Protocols in Immun.*, 1(2): Chapter 5 (1991). Preferably, expression cloning is employed wherein polyadenylated RNA is prepared from a cell responsive to the PRO polypeptide and a cDNA library created from this RNA is divided into pools and used to transfect COS cells or other cells that are not responsive to the PRO polypeptide. Transfected cells that are grown on glass slides are exposed to labeled PRO polypeptide. The PRO polypeptide can be labeled by a variety of means including iodination or inclusion of a recognition site for a site-specific protein kinase. Following fixation and incubation, the slides are subjected to autoradiographic analysis. Positive pools are identified and sub-pools are prepared and re-transfected using an interactive sub-pooling and re-screening process, eventually yielding a single clone that encodes the putative receptor.

As an alternative approach for receptor identification, labeled PRO polypeptide can be photoaffinity-linked with cell membrane or extract preparations that express the receptor molecule. Cross-linked material is resolved by PAGE and exposed to X-ray film. The labeled complex containing the receptor can be excised, resolved into peptide fragments, and subjected to protein micro-sequencing. The amino acid sequence obtained from micro-sequencing would be used to design a set of degenerate oligonucleotide probes to screen a cDNA library to identify the gene encoding the putative receptor.

In another assay for antagonists, mammalian cells or a membrane preparation expressing the receptor would be incubated with labeled PRO polypeptide in the presence of the candidate compound. The ability of the compound to enhance or block this interaction could then be measured.

More specific examples of potential antagonists include an oligonucleotide that binds to the fusions of immunoglobulin with PRO polypeptide, and, in particular, antibodies including, without limitation, poly- and monoclonal antibodies and antibody fragments, single-chain antibodies, anti-idiotypic antibodies, and chimeric or humanized versions of such antibodies or fragments, as well as human antibodies and antibody fragments. Alternatively, a potential antagonist may be a closely related protein, for example, a mutated form of the PRO polypeptide that recognizes the receptor but imparts no effect, thereby competitively inhibiting the action of the PRO polypeptide.

Another potential PRO polypeptide antagonist is an antisense RNA or DNA construct prepared using antisense technology, where, e.g., an antisense RNA or DNA molecule acts to block directly the translation of mRNA by hybridizing to targeted mRNA and preventing protein translation. Antisense technology can be used to control gene expression through triple-helix formation or antisense DNA or RNA, both of which methods are based on binding of a polynucleotide to DNA or RNA. For example, the 5' coding portion of the polynucleotide sequence, which encodes the mature PRO polypeptides herein, is used to design an antisense RNA oligonucleotide of from about 10 to 40 base pairs in length. A DNA oligonucleotide is designed to be complementary to a region of the gene involved in transcription (triple helix—see Lee et al., *Nucl. Acids Res.*, 6:3073 (1979); Cooney et al., *Science,* 241: 456 (1988); Dervan et al., *Science,* 251:1360 (1991)), thereby preventing transcription and the production of the PRO polypeptide. The antisense RNA oligonucleotide hybridizes to the mRNA in vivo and blocks translation of the mRNA molecule into the PRO polypeptide (antisense—Okano, *Neurochem.,* 56:560 (1991); *Oligodeoxynucleotides as Antisense Inhibitors of Gene Expression* (CRC Press: Boca Raton, Fla., 1988). The oligonucleotides described above can also be delivered to cells such that the antisense RNA or DNA may be expressed in vivo to inhibit production of the PRO polypeptide. When antisense DNA is used, oligodeoxyribonucleotides derived from the translation-initiation site, e.g., between about −10 and +10 positions of the target gene nucleotide sequence, are preferred.

Potential antagonists include small molecules that bind to the active site, the receptor binding site, or growth factor or other relevant binding site of the PRO polypeptide, thereby blocking the normal biological activity of the PRO polypeptide. Examples of small molecules include, but are not limited to, small peptides or peptide-like molecules, preferably soluble peptides, and synthetic non-peptidyl organic or inorganic compounds.

Ribozymes are enzymatic RNA molecules capable of catalyzing the specific cleavage of RNA. Ribozymes act by sequence-specific hybridization to the complementary target RNA, followed by endonucleolytic cleavage. Specific ribozyme cleavage sites within a potential RNA target can be identified by known techniques. For further details see, e.g., Rossi, *Current Biology,* 4:469-471 (1994), and PCT publication No. WO 97/33551 (published Sep. 18, 1997).

Nucleic acid molecules in triple-helix formation used to inhibit transcription should be single-stranded and composed of deoxynucleotides. The base composition of these oligonucleotides is designed such that it promotes triple-helix formation via Hoogsteen base-pairing rules, which generally require sizeable stretches of purines or pyrimidines on one strand of a duplex. For further details see, e.g., PCT publication No. WO 97/33551, supra.

These small molecules can be identified by any one or more of the screening assays discussed hereinabove and/or by any other screening techniques well known for those skilled in the art.

Diagnostic and therapeutic uses of the herein disclosed molecules may also be based upon the positive functional assay hits disclosed and described below.

F. Anti-PRO Antibodies

The present invention further provides anti-PRO antibodies. Exemplary antibodies include polyclonal, monoclonal, humanized, bispecific, and heteroconjugate antibodies.

1. Polyclonal Antibodies

The anti-PRO antibodies may comprise polyclonal antibodies. Methods of preparing polyclonal antibodies are known to the skilled artisan. Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. The immunizing agent may include the PRO polypeptide or a fusion protein thereof. It may be useful to conjugate the immunizing agent to a protein known to be immunogenic in the mammal being immunized. Examples of such immunogenic proteins include but are not limited to keyhole limpet hemocyanin, serum albumin, bovine thyroglobulin, and soybean trypsin inhibitor. Examples of adjuvants which may be employed include Freund's complete adjuvant and MPL-TDM adjuvant (monophosphoryl Lipid A, synthetic trehalose dicorynomycolate). The immunization protocol may be selected by one skilled in the art without undue experimentation.

2. Monoclonal Antibodies

The anti-PRO antibodies may, alternatively, be monoclonal antibodies. Monoclonal antibodies may be prepared using hybridoma methods, such as those described by Kohler and Milstein, *Nature,* 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes may be immunized in vitro.

The immunizing agent will typically include the PRO polypeptide or a fusion protein thereof. Generally, either peripheral blood lymphocytes ("PBLs") are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell [Goding, *Monoclonal Antibodies: Principles and Practice*, Academic Press, (1986) pp. 59-103]. Immortalized cell lines are usually transformed mammalian cells, particularly myeloma cells of rodent, bovine and human origin. Usually, rat or mouse myeloma cell lines are employed. The hybridoma cells may be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

Preferred immortalized cell lines are those that fuse efficiently, support stable high level expression of antibody by the selected antibody-producing cells, and are sensitive to a medium such as HAT medium. More preferred immortalized cell lines are murine myeloma lines, which can be obtained, for instance, from the Salk Institute Cell Distribution Center, San Diego, Calif. and the American Type Culture Collection, Manassas, Va. Human myeloma and mouse-human heteromyeloma cell lines also have been described for the production of human monoclonal antibodies [Kozbor, *J. Immunol.*, 133:3001 (1984); Brodeur et al., *Monoclonal Antibody Production Techniques and Applications*, Marcel Dekker, Inc., New York, (1987) pp. 51-63].

The culture medium in which the hybridoma cells are cultured can then be assayed for the presence of monoclonal antibodies directed against PRO. Preferably, the binding specificity of monoclonal antibodies produced by the hybridoma cells is determined by immunoprecipitation or by an in vitro binding assay, such as radioimmunoassay (RIA) or enzyme-linked immunoabsorbent assay (ELISA). Such techniques and assays are known in the art. The binding affinity of the monoclonal antibody can, for example, be determined by the Scatchard analysis of Munson and Pollard, *Anal. Biochem.*, 107:220 (1980).

After the desired hybridoma cells are identified, the clones may be subcloned by limiting dilution procedures and grown by standard methods [Goding, supra]. Suitable culture media for this purpose include, for example, Dulbecco's Modified Eagle's Medium and RPMI-1640 medium. Alternatively, the hybridoma cells may be grown in vivo as ascites in a mammal.

The monoclonal antibodies secreted by the subclones may be isolated or purified from the culture medium or ascites fluid by conventional immunoglobulin purification procedures such as, for example, protein A-Sepharose, hydroxylapatite chromatography, gel electrophoresis, dialysis, or affinity chromatography.

The monoclonal antibodies may also be made by recombinant DNA methods, such as those described in U.S. Pat. No. 4,816,567. DNA encoding the monoclonal antibodies of the invention can be readily isolated and sequenced using conventional procedures (e.g., by using oligonucleotide probes that are capable of binding specifically to genes encoding the heavy and light chains of murine antibodies). The hybridoma cells of the invention serve as a preferred source of such DNA. Once isolated, the DNA may be placed into expression vectors, which are then transfected into host cells such as simian COS cells, Chinese hamster ovary (CHO) cells, or myeloma cells that do not otherwise produce immunoglobulin protein, to obtain the synthesis of monoclonal antibodies in the recombinant host cells. The DNA also may be modified, for example, by substituting the coding sequence for human heavy and light chain constant domains in place of the homologous murine sequences [U.S. Pat. No. 4,816,567; Morrison et al., supra] or by covalently joining to the immunoglobulin coding sequence all or part of the coding sequence for a non-immunoglobulin polypeptide. Such a non-immunoglobulin polypeptide can be substituted for the constant domains of an antibody of the invention, or can be substituted for the variable domains of one antigen-combining site of an antibody of the invention to create a chimeric bivalent antibody.

The antibodies may be monovalent antibodies. Methods for preparing monovalent antibodies are well known in the art. For example, one method involves recombinant expression of immunoglobulin light chain and modified heavy chain. The heavy chain is truncated generally at any point in the Fc region so as to prevent heavy chain crosslinking. Alternatively, the relevant cysteine residues are substituted with another amino acid residue or are deleted so as to prevent crosslinking.

In vitro methods are also suitable for preparing monovalent antibodies. Digestion of antibodies to produce fragments thereof, particularly, Fab fragments, can be accomplished using routine techniques known in the art.

3. Human and Humanized Antibodies

The anti-PRO antibodies of the invention may further comprise humanized antibodies or human antibodies. Humanized forms of non-human (e.g., murine) antibodies are chimeric immunoglobulins, immunoglobulin chains or fragments thereof (such as Fv, Fab, Fab', F(ab')$_2$ or other antigen-binding subsequences of antibodies) which contain minimal sequence derived from non-human immunoglobulin. Humanized antibodies include human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin [Jones et al., *Nature*, 321:522-525 (1986); Riechmann et al., *Nature*, 332:323-329 (1988); and Presta, *Curr. Op. Struct. Biol.*, 2:593-596 (1992)].

Methods for humanizing non-human antibodies are well known in the art. Generally, a humanized antibody has one or more amino acid residues introduced into it from a source which is non-human. These non-human amino acid residues are often referred to as "import" residues, which are typically taken from an "import" variable domain. Humanization can be essentially performed following the method of Winter and co-workers [Jones et al., *Nature*, 321:522-525 (1986); Riechmann et al., *Nature*, 332:323-327 (1988); Verhoeyen et al., *Science*, 239:1534-1536 (1988)], by substituting rodent CDRs or CDR sequences for the corresponding sequences of a human antibody. Accordingly, such "humanized" antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, J. Mol. Biol., 227:381 (1991); Marks et al., J. Mol. Biol., 222:581 (1991)]. The techniques of Cole et al. and Boerner et al. are also available for the preparation of human monoclonal antibodies (Cole et al., Monoclonal Antibodies and Cancer Therapy, Alan R. Liss, p. 77 (1985) and Boerner et al., J. Immunol., 147(1):86-95 (1991)]. Similarly, human antibodies can be made by introducing of human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in the following scientific publications: Marks et al., Bio/Technology 10, 779-783 (1992); Lonberg et al., Nature 368 856-859 (1994); Morrison, Nature 368, 812-13 (1994); Fishwild et al., Nature Biotechnology 14, 845-51 (1996); Neuberger, Nature Biotechnology 14, 826 (1996); Lonberg and Huszar, Intern. Rev. Immunol. 13 65-93 (1995).

The antibodies may also be affinity matured using known selection and/or mutagenesis methods as described above. Preferred affinity matured antibodies have an affinity which is five times, more preferably 10 times, even more preferably 20 or 30 times greater than the starting antibody (generally murine, humanized or human) from which the matured antibody is prepared.

4. Bispecific Antibodies

Bispecific antibodies are monoclonal, preferably human or humanized, antibodies that have binding specificities for at least two different antigens. In the present case, one of the binding specificities is for the PRO, the other one is for any other antigen, and preferably for a cell-surface protein or receptor or receptor subunit.

Methods for making bispecific antibodies are known in the art. Traditionally, the recombinant production of bispecific antibodies is based on the co-expression of two immunoglobulin heavy-chain/light-chain pairs, where the two heavy chains have different specificities [Milstein and Cuello, Nature, 305:537-539 (1983)]. Because of the random assortment of immunoglobulin heavy and light chains, these hybridomas (quadromas) produce a potential mixture of ten different antibody molecules, of which only one has the correct bispecific structure. The purification of the correct molecule is usually accomplished by affinity chromatography steps. Similar procedures are disclosed in WO 93/08829, published 13 May 1993, and in Traunecker et al., EMBO J., 10:3655-3659 (1991).

Antibody variable domains with the desired binding specificities (antibody-antigen combining sites) can be fused to immunoglobulin constant domain sequences. The fusion preferably is with an immunoglobulin heavy-chain constant domain, comprising at least part of the hinge, CH2, and CH3 regions. It is preferred to have the first heavy-chain constant region (CH1) containing the site necessary for light-chain binding present in at least one of the fusions. DNAs encoding the immunoglobulin heavy-chain fusions and, if desired, the immunoglobulin light chain, are inserted into separate expression vectors, and are co-transfected into a suitable host organism. For further details of generating bispecific antibodies see, for example, Suresh et al., Methods in Enzymology, 121:210 (1986).

According to another approach described in WO 96/27011, the interface between a pair of antibody molecules can be engineered to maximize the percentage of heterodimers which are recovered from recombinant cell culture. The preferred interface comprises at least a part of the CH3 region of an antibody constant domain. In this method, one or more small amino acid side chains from the interface of the first antibody molecule are replaced with larger side chains (e.g. tyrosine or tryptophan). Compensatory "cavities" of identical or similar size to the large side chain(s) are created on the interface of the second antibody molecule by replacing large amino acid side chains with smaller ones (e.g. alanine or threonine). This provides a mechanism for increasing the yield of the heterodimer over other unwanted end-products such as homodimers.

Bispecific antibodies can be prepared as full length antibodies or antibody fragments (e.g. F(ab')$_2$ bispecific antibodies). Techniques for generating bispecific antibodies from antibody fragments have been described in the literature. For example, bispecific antibodies can be prepared can be prepared using chemical linkage. Brennan et al., Science 229:81 (1985) describe a procedure wherein intact antibodies are proteolytically cleaved to generate F(ab')$_2$ fragments. These fragments are reduced in the presence of the dithiol complexing agent sodium arsenite to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Fab' fragments may be directly recovered from E. coli and chemically coupled to form bispecific antibodies. Shalaby et al., J. Exp. Med. 175:217-225 (1992) describe the production of a fully humanized bispecific antibody F(ab')$_2$ molecule. Each Fab' fragment was separately secreted from E. coli and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets.

Various technique for making and isolating bispecific antibody fragments directly from recombinant cell culture have also been described. For example, bispecific antibodies have been produced using leucine zippers. Kostelay et al., J. Immunol. 148(5):1547-1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., Proc. Natl. Acad. Sci. USA 90:6444-6448 (1993) has provided an alternative mechanism for making bispecific antibody fragments. The fragments comprise a heavy-chain variable domain ($V_H$) connected to a light-chain variable domain ($V_L$) by a linker which is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See, Gruber et al., *J. Immunol.* 152:5368 (1994).

Antibodies with more than two valencies are contemplated. For example, trispecific antibodies can be prepared. Tutt et al., *J. Immunol.* 147:60 (1991).

Exemplary bispecific antibodies may bind to two different epitopes on a given PRO polypeptide herein. Alternatively, an anti-PRO polypeptide arm may be combined with an arm which binds to a triggering molecule on a leukocyte such as a T-cell receptor molecule (e.g. CD2, CD3, CD28, or B7), or Fc receptors for IgG (FcγR), such as FcγRI (CD64), FcγRII (CD32) and FcγRIII (CD16) so as to focus cellular defense mechanisms to the cell expressing the particular PRO polypeptide. Bispecific antibodies may also be used to localize cytotoxic agents to cells which express a particular PRO polypeptide. These antibodies possess a PRO-binding arm and an arm which binds a cytotoxic agent or a radionuclide chelator, such as EOTUBE, DPTA, DOTA, or TETA. Another bispecific antibody of interest binds the PRO polypeptide and further binds tissue factor (TF).

5. Heteroconjugate Antibodies

Heteroconjugate antibodies are also within the scope of the present invention. Heteroconjugate antibodies are composed of two covalently joined antibodies. Such antibodies have, for example, been proposed to target immune system cells to unwanted cells [U.S. Pat. No. 4,676,980], and for treatment of HIV infection [WO 91/00360; WO 92/200373; EP 03089]. It is contemplated that the antibodies may be prepared in vitro using known methods in synthetic protein chemistry, including those involving crosslinking agents. For example, immunotoxins may be constructed using a disulfide exchange reaction or by forming a thioether bond. Examples of suitable reagents for this purpose include iminothiolate and methyl-4-mercaptobutyrimidate and those disclosed, for example, in U.S. Pat. No. 4,676,980.

6. Effector Function Engineering

It may be desirable to modify the antibody of the invention with respect to effector function, so as to enhance, e.g., the effectiveness of the antibody in treating cancer. For example, cysteine residue(s) may be introduced into the Fc region, thereby allowing interchain disulfide bond formation in this region. The homodimeric antibody thus generated may have improved internalization capability and/or increased complement-mediated cell killing and antibody-dependent cellular cytotoxicity (ADCC). See Caron et al., *J. Exp. Med.,* 176: 1191-1195 (1992) and Shopes, *J. Immunol.,* 148: 2918-2922 (1992). Homodimeric antibodies with enhanced anti-tumor activity may also be prepared using heterobifunctional cross-linkers as described in Wolff et al. *Cancer Research,* 53: 2560-2565 (1993). Alternatively, an antibody can be engineered that has dual Fc regions and may thereby have enhanced complement lysis and ADCC capabilities. See Stevenson et al., *Anti-Cancer Drug Design,* 3: 219-230 (1989).

7. Immunoconjugates

The invention also pertains to immunoconjugates comprising an antibody conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates have been described above. Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), momordica charantia inhibitor, curcin, crotin, sapaonaria officinalis inhibitor, gelonin, mitogellin, restrictocin, phenomycin, enomycin, and the tricothecenes. A variety of radionuclides are available for the production of radioconjugated antibodies. Examples include $^{212}B$, $^{131}I$, $^{131}In$, $^{90}Y$, and $^{189}Re$. Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutareldehyde), bis-azido compounds (such as bis (p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., *Science,* 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026.

In another embodiment, the antibody may be conjugated to a "receptor" (such streptavidin) for utilization in tumor pretargeting wherein the antibody-receptor conjugate is administered to the patient, followed by removal of unbound conjugate from the circulation using a clearing agent and then administration of a "ligand" (e.g., avidin) that is conjugated to a cytotoxic agent (e.g., a radionucleotide).

8. Immunoliposomes

The antibodies disclosed herein may also be formulated as immunoliposomes. Liposomes containing the antibody are prepared by methods known in the art, such as described in Epstein et al., *Proc. Natl. Acad. Sci. USA,* 82: 3688 (1985); Hwang et al., *Proc. Natl Acad. Sci. USA,* 77: 4030 (1980); and U.S. Pat. Nos. 4,485,045 and 4,544,545. Liposomes with enhanced circulation time are disclosed in U.S. Pat. No. 5,013,556.

Particularly useful liposomes can be generated by the reverse-phase evaporation method with a lipid composition comprising phosphatidylcholine, cholesterol, and PEG-derivatized phosphatidylethanolamine (PEG-PE). Liposomes are extruded through filters of defined pore size to yield liposomes with the desired diameter. Fab' fragments of the antibody of the present invention can be conjugated to the liposomes as described in Martin et al., *J. Biol. Chem.,* 257: 286-288 (1982) via a disulfide-interchange reaction. A chemotherapeutic agent (such as Doxorubicin) is optionally contained within the liposome. See Gabizon et al., *J. National Cancer Inst.,* 81(19): 1484 (1989).

9. Pharmaceutical Compositions of Antibodies

Antibodies specifically binding a PRO polypeptide identified herein, as well as other molecules identified by the screening assays disclosed hereinbefore, can be administered for the treatment of various disorders in the form of pharmaceutical compositions.

If the PRO polypeptide is intracellular and whole antibodies are used as inhibitors, internalizing antibodies are preferred. However, lipofections or liposomes can also be used to deliver the antibody, or an antibody fragment, into cells. Where antibody fragments are used, the smallest inhibitory fragment that specifically binds to the binding domain of the target protein is preferred. For example, based upon the variable-region sequences of an antibody, peptide molecules can be designed that retain the ability to bind the target protein sequence. Such peptides can be synthesized chemically and/or produced by recombinant DNA technology. See, e.g., Marasco et al., *Proc. Natl. Acad. Sci. USA,* 90: 7889-7893 (1993). The formulation herein may also contain more than one active compound as necessary for the particular indication being treated, preferably those with complementary activities that do not adversely affect each other. Alternatively, or in addition, the composition may comprise an agent that enhances its function, such as, for example, a cytotoxic agent, cytokine, chemotherapeutic agent, or growth-inhibitory agent. Such molecules are suitably present in combination in amounts that are effective for the purpose intended.

The active ingredients may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles, and nanocapsules) or in macroemulsions. Such techniques are disclosed in Remington's *Pharmaceutical Sciences,* supra.

The formulations to be used for in vivo administration must be sterile. This is readily accomplished by filtration through sterile filtration membranes.

Sustained-release preparations may be prepared. Suitable examples of sustained-release preparations include semipermeable matrices of solid hydrophobic polymers containing the antibody, which matrices are in the form of shaped articles, e.g., films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydrogels release proteins for shorter time periods. When encapsulated antibodies remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

G. Uses for anti-PRO Antibodies

The anti-PRO antibodies of the invention have various utilities. For example, anti-PRO antibodies may be used in diagnostic assays for PRO, e.g., detecting its expression (and in some cases, differential expression) in specific cells, tissues, or serum. Various diagnostic assay techniques known in the art may be used, such as competitive binding assays, direct or indirect sandwich assays and immunoprecipitation assays conducted in either heterogeneous or homogeneous phases [Zola, *Monoclonal Antibodies: A Manual of Techniques,* CRC Press, Inc. (1987) pp. 147-158]. The antibodies used in the diagnostic assays can be labeled with a detectable moiety. The detectable moiety should be capable of producing, either directly or indirectly, a detectable signal. For example, the detectable moiety may be a radioisotope, such as $^3H$, $^{14}C$, $^{32}P$, $^{35}S$, or $^{125}I$, a fluorescent or chemiluminescent compound, such as fluorescein isothiocyanate, rhodamine, or luciferin, or an enzyme, such as alkaline phosphatase, beta-galactosidase or horseradish peroxidase. Any method known in the art for conjugating the antibody to the detectable moiety may be employed, including those methods described by Hunter et al., *Nature,* 144:945 (1962); David et al., *Biochemistry,* 13:1014 (1974); Pain et al., *J. Immunol. Meth.,* 40:219 (1981); and Nygren, *J. Histochem. and Cytochem.,* 30:407 (1982).

Anti-PRO antibodies also are useful for the affinity purification of PRO from recombinant cell culture or natural sources. In this process, the antibodies against PRO are immobilized on a suitable support, such a Sephadex resin or filter paper, using methods well known in the art. The immobilized antibody then is contacted with a sample containing the PRO to be purified, and thereafter the support is washed with a suitable solvent that will remove substantially all the material in the sample except the PRO, which is bound to the immobilized antibody. Finally, the support is washed with another suitable solvent that will release the PRO from the antibody.

The following examples are offered for illustrative purposes only, and are not intended to limit the scope of the present invention in any way.

All patent and literature references cited in the present specification are hereby incorporated by reference in their entirety.

EXAMPLES

Commercially available reagents referred to in the examples were used according to manufacturer's instructions unless otherwise indicated. The source of those cells identified in the following examples, and throughout the specification, by ATCC accession numbers is the American Type Culture Collection, Manassas, Va.

Example 1

Extracellular Domain Homology Screening to Identify Novel Polypeptides and cDNA Encoding Therefor The extracellular domain (ECD) sequences (including the secretion signal sequence, if any) from about 950 known secreted proteins from the Swiss-Prot public database were used to search EST databases. The EST databases included public databases (e.g., Dayhoff, GenBank), and proprietary databases (e.g. LIFESEQ™, Incyte Pharmaceuticals, Palo Alto, Calif.). The search was performed using the computer program BLAST or BLAST-2 (Altschul et al., *Methods in Enzymology,* 266:460-480 (1996)) as a comparison of the ECD protein sequences to a 6 frame translation of the EST sequences. Those comparisons with a BLAST score of 70 (or in some cases 90) or greater that did not encode known proteins were clustered and assembled into consensus DNA sequences with the program "phrap" (Phil Green, University of Washington, Seattle, Wash.).

Using this extracellular domain homology screen, consensus DNA sequences were assembled relative to the other identified EST sequences using phrap. In addition, the consensus DNA sequences obtained were often (but not always) extended using repeated cycles of BLAST or BLAST-2 and phrap to extend the consensus sequence as far as possible using the sources of EST sequences discussed above.

Based upon the consensus sequences obtained as described above, oligonucleotides were then synthesized and used to identify by PCR a cDNA library that contained the sequence of interest and for use as probes to isolate a clone of the full-length coding sequence for a PRO polypeptide. Forward and reverse PCR primers generally range from 20 to 30 nucleotides and are often designed to give a PCR product of about 100-1000 bp in length. The probe sequences are typically 40-55 bp in length. In some cases, additional oligonucleotides are synthesized when the consensus sequence is greater than about 1-1.5 kbp. In order to screen several libraries for a full-length clone, DNA from the libraries was screened by PCR amplification, as per Ausubel et al., *Current Protocols in Molecular Biology*, with the PCR primer pair. A positive library was then used to isolate clones encoding the gene of interest using the probe oligonucleotide and one of the primer pairs.

The cDNA libraries used to isolate the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., *Science*, 253:1278-1280 (1991)) in the unique XhoI and NotI sites.

Example 2

Isolation of cDNA Clones by Amylase Screening

1. Preparation of Oligo dT Primed cDNA Library mRNA was isolated from a human tissue of interest using reagents and protocols from Invitrogen, San Diego, Calif. (Fast Track 2). This RNA was used to generate an oligo dT primed cDNA library in the vector pRK5D using reagents and protocols from Life Technologies, Gaithersburg, Md. (Super Script Plasmid System). In this procedure, the double stranded cDNA was sized to greater than 1000 bp and the SalI/NotI linkered cDNA was cloned into XhoI/NotI cleaved vector. pRK5D is a cloning vector that has an sp6 transcription initiation site followed by an SfiI restriction enzyme site preceding the XhoI/NotI cDNA cloning sites.

2. Preparation of Random Primed cDNA Library

A secondary cDNA library was generated in order to preferentially represent the 5' ends of the primary cDNA clones. Sp6 RNA was generated from the primary library (described above), and this RNA was used to generate a random primed cDNA library in the vector pSST-AMY.0 using reagents and protocols from Life Technologies (Super Script Plasmid System, referenced above). In this procedure the double stranded cDNA was sized to 500-1000 bp, linkered with blunt to NotI adaptors, cleaved with SfiI, and cloned into SfiI/NotI cleaved vector. pSST-AMY.0 is a cloning vector that has a yeast alcohol dehydrogenase promoter preceding the cDNA cloning sites and the mouse amylase sequence (the mature sequence without the secretion signal) followed by the yeast alcohol dehydrogenase terminator, after the cloning sites. Thus, cDNAs cloned into this vector that are fused in frame with amylase sequence will lead to the secretion of amylase from appropriately transfected yeast colonies.

3. Transformation and Detection

DNA from the library described in paragraph 2 above was chilled on ice to which was added electrocompetent DH10B bacteria (Life Technologies, 20 ml). The bacteria and vector mixture was then electroporated as recommended by the manufacturer. Subsequently, SOC media (Life Technologies, 1 ml) was added and the mixture was incubated at 37° C. for 30 minutes. The transformants were then plated onto 20 standard 150 mm LB plates containing ampicillin and incubated for 16 hours (37° C.). Positive colonies were scraped off the plates and the DNA was isolated from the bacterial pellet using standard protocols, e.g. CsCl-gradient. The purified DNA was then carried on to the yeast protocols below.

The yeast methods were divided into three categories: (1) Transformation of yeast with the plasmid/cDNA combined vector; (2) Detection and isolation of yeast clones secreting amylase; and (3) PCR amplification of the insert directly from the yeast colony and purification of the DNA for sequencing and further analysis.

The yeast strain used was HD56-5A (ATCC-90785). This strain has the following genotype: MAT alpha, ura3-52, leu2-3, leu2-112, his3-11, his3-15, MAL+, SUC+, GAL+. Preferably, yeast mutants can be employed that have deficient post-translational pathways. Such mutants may have translocation deficient alleles in sec71, sec72, sec62, with truncated sec71 being most preferred. Alternatively, antagonists (including antisense nucleotides and/or ligands) which interfere with the normal operation of these genes, other proteins implicated in this post translation pathway (e.g., SEC61p, SEC72p, SEC62p, SEC63p, TDJ1p or SSA1p-4p) or the complex formation of these proteins may also be preferably employed in combination with the amylase-expressing yeast.

Transformation was performed based on the protocol outlined by Gietz et al., *Nucl. Acid. Res.*, 20:1425 (1992). Transformed cells were then inoculated from agar into YEPD complex media broth (100 ml) and grown overnight at 30° C. The YEPD broth was prepared as described in Kaiser et al., *Methods in Yeast Genetics*, Cold Spring Harbor Press, Cold Spring Harbor, N.Y., p. 207 (1994). The overnight culture was then diluted to about $2 \times 10^6$ cells/ml (approx. $OD_{600}=0.1$) into fresh YEPD broth (500 ml) and regrown to $1 \times 10^7$ cells/ml (approx. $OD_{600}=0.4$-$0.5$).

The cells were then harvested and prepared for transformation by transfer into GS3 rotor bottles in a Sorval GS3 rotor at 5,000 rpm for 5 minutes, the supernatant discarded, and then resuspended into sterile water, and centrifuged again in 50 ml falcon tubes at 3,500 rpm in a Beckman GS-6KR centrifuge. The supernatant was discarded and the cells were subsequently washed with LiAc/TE (10 ml, 10 mM Tris-HCl, 1 mM EDTA pH 7.5, 100 mM $Li_2OOCCH_3$), and resuspended into LiAc/TE (2.5 ml).

Transformation took place by mixing the prepared cells (100 μl) with freshly denatured single stranded salmon testes DNA (Lofstrand Labs, Gaithersburg, Md.) and transforming DNA (1 μg, vol.<10 μl) in microfuge tubes. The mixture was mixed briefly by vortexing, then 40% PEG/TE (600 μl, 40% polyethylene glycol-4000, 10 mM Tris-HCl, 1 mM EDTA, 100 mM $Li_2OOCCH_3$, pH 7.5) was added. This mixture was gently mixed and incubated at 30° C. while agitating for 30 minutes. The cells were then heat shocked at 42° C. for 15 minutes, and the reaction vessel centrifuged in a microfuge at 12,000 rpm for 5-10 seconds, decanted and resuspended into TE (500 µl, 10 mM Tris-HCl, 1 mM EDTA pH 7.5) followed by recentrifugation. The cells were then diluted into TE (1 ml) and aliquots (200 µl) were spread onto the selective media previously prepared in 150 mm growth plates (VWR).

Alternatively, instead of multiple small reactions, the transformation was performed using a single, large scale reaction, wherein reagent amounts were scaled up accordingly.

The selective media used was a synthetic complete dextrose agar lacking uracil (SCD-Ura) prepared as described in Kaiser et al., *Methods in Yeast Genetics*, Cold Spring Harbor Press, Cold Spring Harbor, N.Y., p. 208-210 (1994). Transformants were grown at 30° C. for 2-3 days.

The detection of colonies secreting amylase was performed by including red starch in the selective growth media. Starch was coupled to the red dye (Reactive Red-120, Sigma) as per the procedure described by Biely et al., *Anal. Biochem.*, 172:176-179 (1988). The coupled starch was incorporated into the SCD-Ura agar plates at a final concentration of 0.15% (w/v), and was buffered with potassium phosphate to a pH of 7.0 (50-100 mM final concentration).

The positive colonies were picked and streaked across fresh selective media (onto 150 mm plates) in order to obtain well isolated and identifiable single colonies. Well isolated single colonies positive for amylase secretion were detected by direct incorporation of red starch into buffered SCD-Ura agar. Positive colonies were determined by their ability to break down starch resulting in a clear halo around the positive colony visualized directly.

4. Isolation of DNA by PCR Amplification

When a positive colony was isolated, a portion of it was picked by a toothpick and diluted into sterile water (30 µl) in a 96 well plate. At this time, the positive colonies were either frozen and stored for subsequent analysis or immediately amplified. An aliquot of cells (5 µl) was used as a template for the PCR reaction in a 25 µl volume containing: 0.5 µl Klentaq (Clontech, Palo Alto, Calif.); 4.0 µl 10 mM dNTP's (Perkin Elmer-Cetus); 2.5 µl Kentaq buffer (Clontech); 0.25 µl forward oligo 1; 0.25 µl reverse oligo 2; 12.5 µl distilled water. The sequence of the forward oligonucleotide 1 was:

5'-TGTAAAACGACGGCCAGT TAAATAGACCTGCAATTATTAATCT-3' (SEQ ID NO:245)

The sequence of reverse oligonucleotide 2 was:

5'-CAGGAAACAGCTATGACC ACCTGCACACCTGCAAATCCATT-3' (SEQ ID NO:246)

PCR was then performed as follows:

| a. | | Denature | 92° C., | 5 minutes |
|---|---|---|---|---|
| b. | 3 cycles of: | Denature | 92° C., | 30 seconds |
| | | Anneal | 59° C., | 30 seconds |
| | | Extend | 72° C., | 60 seconds |
| c. | 3 cycles of: | Denature | 92° C., | 30 seconds |
| | | Anneal | 57° C., | 30 seconds |
| | | Extend | 72° C., | 60 seconds |
| d. | 25 cycles of: | Denature | 92° C., | 30 seconds |
| | | Anneal | 55° C., | 30 seconds |
| | | Extend | 72° C., | 60 seconds |
| e. | | Hold | 4° C. | |

The underlined regions of the oligonucleotides annealed to the ADH promoter region and the amylase region, respectively, and amplified a 307 bp region from vector pSST-AMY.0 when no insert was present. Typically, the first 18 nucleotides of the 5' end of these oligonucleotides contained annealing sites for the sequencing primers. Thus, the total product of the PCR reaction from an empty vector was 343 bp. However, signal sequence-fused cDNA resulted in considerably longer nucleotide sequences.

Following the PCR, an aliquot of the reaction (5 µl) was examined by agarose gel electrophoresis in a 1% agarose gel using a Tris-Borate-EDTA (TBE) buffering system as described by Sambrook et al., supra. Clones resulting in a single strong PCR product larger than 400 bp were further analyzed by DNA sequencing after purification with a 96 Qiaquick PCR clean-up column (Qiagen Inc., Chatsworth, Calif.).

Example 3

Isolation of cDNA Clones Using Signal Algorithm Analysis

Various polypeptide-encoding nucleic acid sequences were identified by applying a proprietary signal sequence finding algorithm developed by Genentech, Inc. (South San Francisco, Calif.) upon ESTs as well as clustered and assembled EST fragments from public (e.g., GenBank) and/or private (LIFESEQ®, Incyte Pharmaceuticals, Inc., Palo Alto, Calif.) databases. The signal sequence algorithm computes a secretion signal score based on the character of the DNA nucleotides surrounding the first and optionally the second methionine codon(s) (ATG) at the 5'-end of the sequence or sequence fragment under consideration. The nucleotides following the first ATG must code for at least 35 unambiguous amino acids without any stop codons. If the first ATG has the required amino acids, the second is not examined. If neither meets the requirement, the candidate sequence is not scored. In order to determine whether the EST sequence contains an authentic signal sequence, the DNA and corresponding amino acid sequences surrounding the ATG codon are scored using a set of seven sensors (evaluation parameters) known to be associated with secretion signals. Use of this algorithm resulted in the identification of numerous polypeptide-encoding nucleic acid sequences.

Example 4

Isolation of cDNA Clones Encoding Human PRO Polypeptides

Using the techniques described in Examples 1 to 3 above, numerous full-length cDNA clones were identified as encoding PRO polypeptides as disclosed herein. These cDNAs were then deposited under the terms of the Budapest Treaty with the American Type Culture Collection, 10801 University Blvd., Manassas, Va. 20110-2209, USA (ATCC) as shown in Table 7 below.

TABLE 7

| Material | ATCC Dep. No. | Deposit Date |
|---|---|---|
| DNA94849-2960 | PTA-2306 | Jul. 25, 2000 |
| DNA96883-2745 | PTA-544 | Aug. 17, 1999 |
| DNA96894-2675 | PTA-260 | Jun. 22, 1999 |

TABLE 7-continued

| Material | ATCC Dep. No. | Deposit Date |
| --- | --- | --- |
| DNA100272-2969 | PTA-2299 | Jul. 25, 2000 |
| DNA108696-2966 | PTA-2315 | Aug. 1, 2000 |
| DNA117935-2801 | PTA-1088 | Dec. 22, 1999 |
| DNA119474-2803 | PTA-1097 | Dec. 22, 1999 |
| DNA119498-2965 | PTA-2298 | Jul. 25, 2000 |
| DNA119502-2789 | PTA-1082 | Dec. 22, 1999 |
| DNA119516-2797 | PTA-1083 | Dec. 22, 1999 |
| DNA119530-2968 | PTA-2396 | Aug. 8, 2000 |
| DNA121772-2741 | PTA-1030 | Dec. 7, 1999 |
| DNA125148-2782 | PTA-955 | Nov. 16, 1999 |
| DNA125150-2793 | PTA-1085 | Dec. 22, 1999 |
| DNA125151-2784 | PTA-1029 | Dec. 7, 1999 |
| DNA125181-2804 | PTA-1096 | Dec. 22, 1999 |
| DNA125192-2794 | PTA-1086 | Dec. 22, 1999 |
| DNA125196-2792 | PTA-1091 | Dec. 22, 1999 |
| DNA125200-2810 | PTA-1186 | Jan. 11, 2000 |
| DNA125214-2814 | PTA-1270 | Feb. 2, 2000 |
| DNA125219-2799 | PTA-1084 | Dec. 22, 1999 |
| DNA128309-2825 | PTA-1340 | Feb. 8, 2000 |
| DNA129535-2796 | PTA-1087 | Dec. 22, 1999 |
| DNA129549-2798 | PTA-1099 | Dec. 22, 1999 |
| DNA129580-2863 | PTA-1584 | Mar. 28, 2000 |
| DNA129794-2967 | PTA-2305 | Jul. 25, 2000 |
| DNA131590-2962 | PTA-2297 | Jul. 25, 2000 |
| DNA135173-2811 | PTA-1184 | Jan. 11, 2000 |
| DNA138039-2828 | PTA-1343 | Feb. 8, 2000 |
| DNA139540-2807 | PTA-1187 | Jan. 11, 2000 |
| DNA139602-2859 | PTA-1588 | Mar. 28, 2000 |
| DNA139632-2880 | PTA-1629 | Apr. 4, 2000 |
| DNA139686-2823 | PTA-1264 | Feb. 2, 2000 |
| DNA142392-2800 | PTA-1092 | Dec. 22, 1999 |
| DNA143076-2787 | PTA-1028 | Dec. 7, 1999 |
| DNA143294-2818 | PTA-1182 | Jan. 11, 2000 |
| DNA143514-2817 | PTA-1266 | Feb. 2, 2000 |
| DNA144841-2816 | PTA-1188 | Jan. 11, 2000 |
| DNA148380-2827 | PTA-1181 | Jan. 11, 2000 |
| DNA149995-2871 | PTA-1971 | May 31, 2000 |
| DNA167678-2963 | PTA-2302 | Jul. 25, 2000 |
| DNA168028-2956 | PTA-2304 | Jul. 25, 2000 |
| DNA173894-2947 | PTA-2108 | Jun. 20, 2000 |
| DNA176775-2957 | PTA-2303 | Jul. 25, 2000 |
| DNA177313-2982 | PTA-2251 | Jul. 19, 2000 |
| DNA57700-1408 | 203583 | Jan. 12, 1999 |
| DNA62872-1509 | 203100 | Aug. 4, 1998 |
| DNA62876-1517 | 203095 | Aug. 4, 1998 |
| DNA66660-1585 | 203279 | Sep. 22, 1998 |
| DNA34434-1139 | 209252 | Sep. 16, 1997 |
| DNA44804-1248 | 209527 | Dec. 10, 1997 |
| DNA52758-1399 | 209773 | Apr. 14, 1998 |
| DNA59849-1504 | 209986 | Jun. 16, 1998 |
| DNA65410-1569 | 203231 | Sep. 15, 1998 |
| DNA71290-1630 | 203275 | Sep. 22, 1998 |
| DNA33100-1159 | 209377 | Oct. 16, 1997 |
| DNA64896-1539 | 203238 | Sep. 9, 1998 |
| DNA84920-2614 | 203966 | Apr. 27, 1999 |
| DNA23330-1390 | 209775 | Apr. 14, 1998 |
| DNA32286-1191 | 209385 | Oct. 16, 1997 |
| DNA35673-1201 | 209418 | Oct. 28, 1997 |
| DNA43316-1237 | 209487 | Nov. 21, 1997 |
| DNA44184-1319 | 209704 | Mar. 26, 1998 |
| DNA45419-1252 | 209616 | Feb. 5, 1998 |
| DNA48314-1320 | 209702 | Mar. 26, 1998 |
| DNA50921-1458 | 209859 | May 12, 1998 |
| DNA53987 | 209858 | May 12, 1998 |
| DNA56047-1456 | 209948 | Jun. 9, 1998 |
| DNA56405-1357 | 209849 | May 6, 1998 |
| DNA56531-1648 | 203286 | Sep. 29, 1998 |
| DNA56865-1491 | 203022 | Jun. 23, 1998 |
| DNA57694-1341 | 203017 | Jun. 23, 1998 |
| DNA57708-1411 | 203021 | Jun. 23, 1998 |
| DNA57836-1338 | 203025 | Jun. 23, 1998 |
| DNA57841-1522 | 203458 | Nov. 3, 1998 |
| DNA58847-1383 | 209879 | May 20, 1998 |
| DNA59212-1627 | 203245 | Sep. 9, 1998 |
| DNA59588-1571 | 203106 | Aug. 11, 1998 |
| DNA59622-1334 | 209984 | Jun. 16, 1998 |
| DNA59847-2510 | 203576 | Jan. 12, 1999 |
| DNA60615-1483 | 209980 | Jun. 16, 1998 |
| DNA60621-1516 | 203091 | Aug. 4, 1998 |
| DNA62814-1521 | 203093 | Aug. 4, 1998 |
| DNA64883-1526 | 203253 | Sep. 9, 1998 |
| DNA64889-1541 | 203250 | Sep. 9, 1998 |
| DNA64897-1628 | 203216 | Sep. 15, 1998 |
| DNA64903-1553 | 203223 | Sep. 15, 1998 |
| DNA64907-1163-1 | 203242 | Sep. 9, 1998 |
| DNA64950-1590 | 203224 | Sep. 15, 1998 |
| DNA64952-1568 | 203222 | Sep. 15, 1998 |
| DNA65402-1540 | 203252 | Sep. 9, 1998 |
| DNA65405-1547 | 203476 | Nov. 17, 1998 |
| DNA66663-1598 | 203268 | Sep. 22, 1998 |
| DNA66667 | 203267 | Sep. 22, 1998 |
| DNA66675-1587 | 203282 | Sep. 22, 1998 |
| DNA67300-1605 | 203163 | Aug. 25, 1998 |
| DNA68872-1620 | 203160 | Aug. 25, 1998 |
| DNA71269-1621 | 203284 | Sep. 22, 1998 |
| DNA73736-1657 | 203466 | Nov. 17, 1998 |
| DNA73739-1645 | 203270 | Sep. 22, 1998 |
| DNA76400-2528 | 203573 | Jan. 12, 1999 |
| DNA76532-1702 | 203473 | Nov. 17, 1998 |
| DNA76541-1675 | 203409 | Oct. 27, 1998 |
| DNA79862-2522 | 203550 | Dec. 22, 1998 |
| DNA81754-2532 | 203542 | Dec. 15, 1998 |
| DNA81761-2583 | 203862 | Mar. 23, 1999 |
| DNA83500-2506 | 203391 | Oct. 29, 1998 |
| DNA84210-2576 | 203818 | Mar. 2, 1999 |
| DNA86571-2551 | 203660 | Feb. 9, 1999 |
| DNA92218-2554 | 203834 | Mar. 9, 1999 |
| DNA92223-2567 | 203851 | Mar. 16, 1999 |
| DNA92265-2669 | PTA-256 | Jun. 22, 1999 |
| DNA92274-2617 | 203971 | Apr. 27, 1999 |
| DNA108760-2740 | PTA-548 | Aug. 17, 1999 |
| DNA108792-2753 | PTA-617 | Aug. 31, 1999 |
| DNA111750-2706 | PTA-489 | Aug. 3, 1999 |
| DNA119514-2772 | PTA-946 | Nov. 9, 1999 |
| DNA125185-2806 | PTA-1031 | Dec. 7, 1999 |

These deposits were made under the provisions of the Budapest Treaty on the International Recognition of the Deposit of Microorganisms for the Purpose of Patent Procedure and the Regulations thereunder (Budapest Treaty). This assures maintenance of a viable culture of the deposit for 30 years from the date of deposit and for at least five (5) years after the most recent request for the furnishing of a sample of the deposit received by the depository. The deposits will be made available by ATCC under the terms of the Budapest Treaty, and subject to an agreement between Genentech, Inc. and ATCC, which assures that all restrictions imposed by the depositor on the availability to the public of the deposited material will be irrevocably removed upon the granting of the pertinent U.S. patent, assures availability of the progeny to one determined by the U.S. Commissioner of Patents and Trademarks to be entitled thereto according to 35 USC § 122 and the Commissioner's rules pursuant thereto (including 37 CFR § 1.14 with particular reference to 886 OG 638).

The assignee of the present application has agreed that if a culture of the materials on deposit should die or be lost or destroyed when cultivated under suitable conditions, the materials will be promptly replaced on notification with another of the same. Availability of the deposited material is not to be construed as a license to practice the invention in contravention of the rights granted under the authority of any government in accordance with its patent laws.

Example 5

Isolation of cDNA Clones Encoding Human PRO6004, PRO5723, PRO3444, and PRO9940

DNA molecules encoding the PRO840, PRO1338, PRO6004, PRO5723, PRO3444, and PRO9940 polypeptides shown in the accompanying figures were obtained through GenBank.

Example 6

Use of PRO as a Hybridization Probe

The following method describes use of a nucleotide sequence encoding PRO as a hybridization probe.

DNA comprising the coding sequence of full-length or mature PRO as disclosed herein is employed as a probe to screen for homologous DNAs (such as those encoding naturally-occurring variants of PRO) in human tissue cDNA libraries or human tissue genomic libraries.

Hybridization and washing of filters containing either library DNAs is performed under the following high stringency conditions. Hybridization of radiolabeled PRO-derived probe to the filters is performed in a solution of 50% formamide, 5×SSC, 0.1% SDS, 0.1% sodium pyrophosphate, 50 mM sodium phosphate, pH 6.8, 2× Denhardt's solution, and 10% dextran sulfate at 42° C. for 20 hours. Washing of the filters is performed in an aqueous solution of 0.1×SSC and 0.1% SDS at 42° C.

DNAs having a desired sequence identity with the DNA encoding full-length native sequence PRO can then be identified using standard techniques known in the art.

Example 7

Expression of PRO in E. coli

This example illustrates preparation of an unglycosylated form of PRO by recombinant expression in E. coli.

The DNA sequence encoding PRO is initially amplified using selected PCR primers. The primers should contain restriction enzyme sites which correspond to the restriction enzyme sites on the selected expression vector. A variety of expression vectors may be employed. An example of a suitable vector is pBR322 (derived from E. coli; see Bolivar et al., Gene, 2:95 (1977)) which contains genes for ampicillin and tetracycline resistance. The vector is digested with restriction enzyme and dephosphorylated. The PCR amplified sequences are then ligated into the vector. The vector will preferably include sequences which encode for an antibiotic resistance gene, a trp promoter, a polyhis leader (including the first six STII codons, polyhis sequence, and enterokinase cleavage site), the PRO coding region, lambda transcriptional terminator, and an argU gene.

The ligation mixture is then used to transform a selected E. coli strain using the methods described in Sambrook et al., supra. Transformants are identified by their ability to grow on LB plates and antibiotic resistant colonies are then selected. Plasmid DNA can be isolated and confirmed by restriction analysis and DNA sequencing.

Selected clones can be grown overnight in liquid culture medium such as LB broth supplemented with antibiotics. The overnight culture may subsequently be used to inoculate a larger scale culture. The cells are then grown to a desired optical density, during which the expression promoter is turned on.

After culturing the cells for several more hours, the cells can be harvested by centrifugation. The cell pellet obtained by the centrifugation can be solubilized using various agents known in the art, and the solubilized PRO protein can then be purified using a metal chelating column under conditions that allow tight binding of the protein.

PRO may be expressed in E. coli in a poly-His tagged form, using the following procedure. The DNA encoding PRO is initially amplified using selected PCR primers. The primers will contain restriction enzyme sites which correspond to the restriction enzyme sites on the selected expression vector, and other useful sequences providing for efficient and reliable translation initiation, rapid purification on a metal chelation column, and proteolytic removal with enterokinase. The PCR-amplified, poly-His tagged sequences are then ligated into an expression vector, which is used to transform an E. coli host based on strain 52 (W3110 fuhA(tonA) lon galE rpoHts(htpRts) clpP(lacIq). Transformants are first grown in LB containing 50 mg/ml carbenicillin at 30° C. with shaking until an O.D.600 of 3-5 is reached. Cultures are then diluted 50-100 fold into CRAP media (prepared by mixing 3.57 g $(NH_4)_2SO_4$, 0.71 g sodium citrate.2H2O, 1.07 g KCl, 5.36 g Difco yeast extract, 5.36 g Sheffield hycase SF in 500 mL water, as well as 110 mM MPOS, pH 7.3, 0.55% (w/v) glucose and 7 mM $MgSO_4$) and grown for approximately 20-30 hours at 30° C. with shaking. Samples are removed to verify expression by SDS-PAGE analysis, and the bulk culture is centrifuged to pellet the cells. Cell pellets are frozen until purification and refolding.

E. coli paste from 0.5 to 1 L fermentations (6-10 g pellets) is resuspended in 10 volumes (w/v) in 7 M guanidine, 20 mM Tris, pH 8 buffer. Solid sodium sulfite and sodium tetrathionate is added to make final concentrations of 0.1M and 0.02 M, respectively, and the solution is stirred overnight at 4° C. This step results in a denatured protein with all cysteine residues blocked by sulfitolization. The solution is centrifuged at 40,000 rpm in a Beckman Ultracentrifuge for 30 min. The supernatant is diluted with 3-5 volumes of metal chelate column buffer (6 M guanidine, 20 mM Tris, pH 7.4) and filtered through 0.22 micron filters to clarify. The clarified extract is loaded onto a 5 ml Qiagen Ni-NTA metal chelate column equilibrated in the metal chelate column buffer. The column is washed with additional buffer containing 50 mM imidazole (Calbiochem, Utrol grade), pH 7.4. The protein is eluted with buffer containing 250 mM imidazole. Fractions containing the desired protein are pooled and stored at 4° C. Protein concentration is estimated by its absorbance at 280 nm using the calculated extinction coefficient based on its amino acid sequence.

The proteins are refolded by diluting the sample slowly into freshly prepared refolding buffer consisting of: 20 mM Tris, pH 8.6, 0.3 M NaCl, 2.5 M urea, 5 mM cysteine, 20 mM glycine and 1 mM EDTA. Refolding volumes are chosen so that the final protein concentration is between 50 to 100 micrograms/ml. The refolding solution is stirred gently at 4° C. for 12-36 hours. The refolding reaction is quenched by the addition of TFA to a final concentration of 0.4% (pH of approximately 3). Before further purification of the protein, the solution is filtered through a 0.22 micron filter and acetonitrile is added to 2-10% final concentration. The refolded protein is chromatographed on a Poros R1/H reversed phase column using a mobile buffer of 0.1% TFA with elution with a gradient of acetonitrile from 10 to 80%. Aliquots of fractions with A280 absorbance are analyzed on SDS polyacrylamide gels and fractions containing homogeneous refolded protein are pooled. Generally, the properly refolded species of most proteins are eluted at the lowest concentrations of acetonitrile since those species are the most compact with their hydrophobic interiors shielded from interaction with the reversed phase resin. Aggregated species are usually eluted at higher acetonitrile concentrations. In addition to resolving misfolded forms of proteins from the desired form, the reversed phase step also removes endotoxin from the samples.

Fractions containing the desired folded PRO polypeptide are pooled and the acetonitrile removed using a gentle stream of nitrogen directed at the solution. Proteins are formulated into 20 mM Hepes, pH 6.8 with 0.14 M sodium chloride and 4% mannitol by dialysis or by gel filtration using G25 Superfine (Pharmacia) resins equilibrated in the formulation buffer and sterile filtered.

Many of the PRO polypeptides disclosed herein were successfully expressed as described above.

Example 8

Expression of PRO in Mammalian Cells

This example illustrates preparation of a potentially glycosylated form of PRO by recombinant expression in mammalian cells.

The vector, pRK5 (see EP 307,247, published Mar. 15, 1989), is employed as the expression vector. Optionally, the PRO DNA is ligated into pRK5 with selected restriction enzymes to allow insertion of the PRO DNA using ligation methods such as described in Sambrook et al., supra. The resulting vector is called pRK5-PRO.

In one embodiment, the selected host cells may be 293 cells. Human 293 cells (ATCC CCL 1573) are grown to confluence in tissue culture plates in medium such as DMEM supplemented with fetal calf serum and optionally, nutrient components and/or antibiotics. About 10 μg pRK5-PRO DNA is mixed with about 1 μg DNA encoding the VA RNA gene [Thimmappaya et al., *Cell*, 31:543 (1982)] and dissolved in 500 μl of 1 mM Tris-HCl, 0.1 mM EDTA, 0.227 M $CaCl_2$. To this mixture is added, dropwise, 500 μl of 50 mM HEPES (pH 7.35), 280 mM NaCl, 1.5 mM $NaPO_4$, and a precipitate is allowed to form for 10 minutes at 25° C. The precipitate is suspended and added to the 293 cells and allowed to settle for about four hours at 37° C. The culture medium is aspirated off and 2 ml of 20% glycerol in PBS is added for 30 seconds. The 293 cells are then washed with serum free medium, fresh medium is added and the cells are incubated for about 5 days.

Approximately 24 hours after the transfections, the culture medium is removed and replaced with culture medium (alone) or culture medium containing 200 μCi/ml $^{35}$S-cysteine and 200 μCi/ml $^{35}$S-methionine. After a 12 hour incubation, the conditioned medium is collected, concentrated on a spin filter, and loaded onto a 15% SDS gel. The processed gel may be dried and exposed to film for a selected period of time to reveal the presence of PRO polypeptide. The cultures containing transfected cells may undergo further incubation (in serum free medium) and the medium is tested in selected bioassays.

In an alternative technique, PRO may be introduced into 293 cells transiently using the dextran sulfate method described by Somparyrac et al., *Proc. Natl. Acad. Sci.*, 12:7575 (1981). 293 cells are grown to maximal density in a spinner flask and 700 μg pRK5-PRO DNA is added. The cells are first concentrated from the spinner flask by centrifugation and washed with PBS. The DNA-dextran precipitate is incubated on the cell pellet for four hours. The cells are treated with 20% glycerol for 90 seconds, washed with tissue culture medium, and re-introduced into the spinner flask containing tissue culture medium, 5 μg/ml bovine insulin and 0.1 μg/ml bovine transferrin. After about four days, the conditioned media is centrifuged and filtered to remove cells and debris. The sample containing expressed PRO can then be concentrated and purified by any selected method, such as dialysis and/or column chromatography.

In another embodiment, PRO can be expressed in CHO cells. The pRK5-PRO can be transfected into CHO cells using known reagents such as $CaPO_4$ or DEAE-dextran. As described above, the cell cultures can be incubated, and the medium replaced with culture medium (alone) or medium containing a radiolabel such as $^{35}$S-methionine. After determining the presence of PRO polypeptide, the culture medium may be replaced with serum free medium. Preferably, the cultures are incubated for about 6 days, and then the conditioned medium is harvested. The medium containing the expressed PRO can then be concentrated and purified by any selected method.

Epitope-tagged PRO may also be expressed in host CHO cells. The PRO may be subcloned out of the pRK5 vector. The subclone insert can undergo PCR to fuse in frame with a selected epitope tag such as a poly-his tag into a Baculovirus expression vector. The poly-his tagged PRO insert can then be subcloned into a SV40 driven vector containing a selection marker such as DHFR for selection of stable clones. Finally, the CHO cells can be transfected (as described above) with the SV40 driven vector. Labeling may be performed, as described above, to verify expression. The culture medium containing the expressed poly-His tagged PRO can then be concentrated and purified by any selected method, such as by $Ni^{2+}$-chelate affinity chromatography.

PRO may also be expressed in CHO and/or COS cells by a transient expression procedure or in CHO cells by another stable expression procedure.

Stable expression in CHO cells is performed using the following procedure. The proteins are expressed as an IgG construct (immunoadhesin), in which the coding sequences for the soluble forms (e.g. extracellular domains) of the respective proteins are fused to an IgG1 constant region sequence containing the hinge, CH2 and CH2 domains and/or is a poly-His tagged form.

Following PCR amplification, the respective DNAs are subcloned in a CHO expression vector using standard techniques as described in Ausubel et al., *Current Protocols of Molecular Biology*, Unit 3.16, John Wiley and Sons (1997). CHO expression vectors are constructed to have compatible restriction sites 5' and 3' of the DNA of interest to allow the convenient shuttling of cDNA's. The vector used expression in CHO cells is as described in Lucas et al., *Nucl. Acids Res.* 24:9 (1774-1779 (1996), and uses the SV40 early promoter/enhancer to drive expression of the cDNA of interest and dihydrofolate reductase (DHFR). DHFR expression permits selection for stable maintenance of the plasmid following transfection.

Twelve micrograms of the desired plasmid DNA is introduced into approximately 10 million CHO cells using commercially available transfection reagents Superfect® (Qiagen), Dosper® or Fugene® (Boehringer Mannheim). The cells are grown as described in Lucas et al., supra. Approximately $3\times10^7$ cells are frozen in an ampule for further growth and production as described below.

The ampules containing the plasmid DNA are thawed by placement into water bath and mixed by vortexing. The contents are pipetted into a centrifuge tube containing 10 mLs of media and centrifuged at 1000 rpm for 5 minutes.

The supernatant is aspirated and the cells are resuspended in 10 mL of selective media (0.2 µm filtered PS20 with 5% 0.2 µm diafiltered fetal bovine serum). The cells are then aliquoted into a 100 mL spinner containing 90 mL of selective media. After 1-2 days, the cells are transferred into a 250 mL spinner filled with 150 mL selective growth medium and incubated at 37° C. After another 2-3 days, 250 mL, 500 mL and 2000 mL spinners are seeded with $3 \times 10^5$ cells/mL. The cell media is exchanged with fresh media by centrifugation and resuspension in production medium. Although any suitable CHO media may be employed, a production medium described in U.S. Pat. No. 5,122,469, issued Jun. 16, 1992 may actually be used. A 3 L production spinner is seeded at $1.2 \times 10^6$ cells/mL. On day 0, the cell number pH ie determined. On day 1, the spinner is sampled and sparging with filtered air is commenced. On day 2, the spinner is sampled, the temperature shifted to 33° C., and 30 mL of 500 g/L glucose and 0.6 mL of 10% antifoam (e.g., 35% polydimethylsiloxane emulsion, Dow Corning 365 Medical Grade Emulsion) taken. Throughout the production, the pH is adjusted as necessary to keep it at around 7.2. After 10 days, or until the viability dropped below 70%, the cell culture is harvested by centrifugation and filtering through a 0.22 µm filter. The filtrate was either stored at 4° C. or immediately loaded onto columns for purification.

For the poly-His tagged constructs, the proteins are purified using a Ni-NTA column (Qiagen). Before purification, imidazole is added to the conditioned media to a concentration of 5 mM. The conditioned media is pumped onto a 6 ml Ni-NTA column equilibrated in 20 mM Hepes, pH 7.4, buffer containing 0.3 M NaCl and 5 mM imidazole at a flow rate of 4-5 ml/min. at 4° C. After loading, the column is washed with additional equilibration buffer and the protein eluted with equilibration buffer containing 0.25 M imidazole. The highly purified protein is subsequently desalted into a storage buffer containing 10 mM Hepes, 0.14 M NaCl and 4% mannitol, pH 6.8, with a 25 ml G25 Superfine (Pharmacia) column and stored at −80° C.

Immunoadhesin (Fc-containing) constructs are purified from the conditioned media as follows. The conditioned medium is pumped onto a 5 ml Protein A column (Pharmacia) which had been equilibrated in 20 mM Na phosphate buffer, pH 6.8. After loading, the column is washed extensively with equilibration buffer before elution with 100 mM citric acid, pH 3.5. The eluted protein is immediately neutralized by collecting 1 ml fractions into tubes containing 275 µL of 1 M Tris buffer, pH 9. The highly purified protein is subsequently desalted into storage buffer as described above for the poly-His tagged proteins. The homogeneity is assessed by SDS polyacrylamide gels and by N-terminal amino acid sequencing by Edman degradation.

Many of the PRO polypeptides disclosed herein were successfully expressed as described above.

Example 9

Expression of PRO in Yeast

The following method describes recombinant expression of PRO in yeast.

First, yeast expression vectors are constructed for intracellular production or secretion of PRO from the ADH2/GAPDH promoter. DNA encoding PRO and the promoter is inserted into suitable restriction enzyme sites in the selected plasmid to direct intracellular expression of PRO. For secretion, DNA encoding PRO can be cloned into the selected plasmid, together with DNA encoding the ADH2/GAPDH promoter, a native PRO signal peptide or other mammalian signal peptide, or, for example, a yeast alpha-factor or invertase secretory signal/leader sequence, and linker sequences (if needed) for expression of PRO.

Yeast cells, such as yeast strain AB110, can then be transformed with the expression plasmids described above and cultured in selected fermentation media. The transformed yeast supernatants can be analyzed by precipitation with 10% trichloroacetic acid and separation by SDS-PAGE, followed by staining of the gels with Coomassie Blue stain.

Recombinant PRO can subsequently be isolated and purified by removing the yeast cells from the fermentation medium by centrifugation and then concentrating the medium using selected cartridge filters. The concentrate containing PRO may further be purified using selected column chromatography resins.

Many of the PRO polypeptides disclosed herein were successfully expressed as described above.

Example 10

Expression of PRO in Baculovirus-Infected Insect Cells

The following method describes recombinant expression of PRO in Baculovirus-infected insect cells.

The sequence coding for PRO is fused upstream of an epitope tag contained within a baculovirus expression vector. Such epitope tags include poly-his tags and immunoglobulin tags (like Fc regions of IgG). A variety of plasmids may be employed, including plasmids derived from commercially available plasmids such as pVL1393 (Novagen). Briefly, the sequence encoding PRO or the desired portion of the coding sequence of PRO such as the sequence encoding the extracellular domain of a transmembrane protein or the sequence encoding the mature protein if the protein is extracellular is amplified by PCR with primers complementary to the 5' and 3' regions. The 5' primer may incorporate flanking (selected) restriction enzyme sites. The product is then digested with those selected restriction enzymes and subcloned into the expression vector.

Recombinant baculovirus is generated by co-transfecting the above plasmid and BaculoGold™ virus DNA (Pharmingen) into *Spodoptera frugiperda* ("Sf9") cells (ATCC CRL 1711) using lipofectin (commercially available from GIBCO-BRL). After 4-5 days of incubation at 28° C., the released viruses are harvested and used for further amplifications. Viral infection and protein expression are performed as described by O'Reilley et al., *Baculovirus expression vectors: A Laboratory Manual*, Oxford: Oxford University Press (1994).

Expressed poly-his tagged PRO can then be purified, for example, by $Ni^{2+}$-chelate affinity chromatography as follows. Extracts are prepared from recombinant virus-infected Sf9 cells as described by Rupert et al., *Nature*, 362: 175-179 (1993). Briefly, Sf9 cells are washed, resuspended in sonication buffer (25 mL Hepes, pH 7.9; 12.5 mM $MgCl_2$; 0.1 mM EDTA; 10% glycerol; 0.1% NP-40; 0.4 M KCl), and sonicated twice for 20 seconds on ice. The sonicates are cleared by centrifugation, and the supernatant is diluted 50-fold in loading buffer (50 mM phosphate, 300 mM NaCl, 10% glycerol, pH 7.8) and filtered through a 0.45 µm filter. A $Ni^{2+}$-NTA agarose column (commercially available from Qiagen) is prepared with a bed volume of 5 mL, washed with 25 mL of water and equilibrated with 25 mL of loading buffer. The filtered cell extract is loaded onto the column at 0.5 mL per minute. The column is washed to baseline $A_{280}$ with loading buffer, at which point fraction collection is started. Next, the column is washed with a secondary wash buffer (50 mM phosphate; 300 mM NaCl, 10% glycerol, pH 6.0), which elutes nonspecifically bound protein. After reaching $A_{280}$ baseline again, the column is developed with a 0 to 500 mM Imidazole gradient in the secondary wash buffer. One mL fractions are collected and analyzed by SDS-PAGE and silver staining or Western blot with $Ni^{2+}$-NTA-conjugated to alkaline phosphatase (Qiagen). Fractions containing the eluted $His_{10}$-tagged PRO are pooled and dialyzed against loading buffer.

Alternatively, purification of the IgG tagged (or Fc tagged) PRO can be performed using known chromatography techniques, including for instance, Protein A or protein G column chromatography.

Many of the PRO polypeptides disclosed herein were successfully expressed as described above.

Example 11

Preparation of Antibodies that Bind PRO

This example illustrates preparation of monoclonal antibodies which can specifically bind PRO.

Techniques for producing the monoclonal antibodies are known in the art and are described, for instance, in Goding, supra. Immunogens that may be employed include purified PRO, fusion proteins containing PRO, and cells expressing recombinant PRO on the cell surface. Selection of the immunogen can be made by the skilled artisan without undue experimentation.

Mice, such as Balb/c, are immunized with the PRO immunogen emulsified in complete Freund's adjuvant and injected subcutaneously or intraperitoneally in an amount from 1-100 micrograms. Alternatively, the immunogen is emulsified in MPL-TDM adjuvant (Ribi Immunochemical Research, Hamilton, Mont.) and injected into the animal's hind foot pads. The immunized mice are then boosted 10 to 12 days later with additional immunogen emulsified in the selected adjuvant. Thereafter, for several weeks, the mice may also be boosted with additional immunization injections. Serum samples may be periodically obtained from the mice by retro-orbital bleeding for testing in ELISA assays to detect anti-PRO antibodies.

After a suitable antibody titer has been detected, the animals "positive" for antibodies can be injected with a final intravenous injection of PRO. Three to four days later, the mice are sacrificed and the spleen cells are harvested. The spleen cells are then fused (using 35% polyethylene glycol) to a selected murine myeloma cell line such as P3X63AgU.1, available from ATCC, No. CRL 1597. The fusions generate hybridoma cells which can then be plated in 96 well tissue culture plates containing HAT (hypoxanthine, aminopterin, and thymidine) medium to inhibit proliferation of non-fused cells, myeloma hybrids, and spleen cell hybrids.

The hybridoma cells will be screened in an ELISA for reactivity against PRO. Determination of "positive" hybridoma cells secreting the desired monoclonal antibodies against PRO is within the skill in the art.

The positive hybridoma cells can be injected intraperitoneally into syngeneic Balb/c mice to produce ascites containing the anti-PRO monoclonal antibodies. Alternatively, the hybridoma cells can be grown in tissue culture flasks or roller bottles. Purification of the monoclonal antibodies produced in the ascites can be accomplished using ammonium sulfate precipitation, followed by gel exclusion chromatography. Alternatively, affinity chromatography based upon binding of antibody to protein A or protein G can be employed.

Example 12

Purification of PRO Polypeptides Using Specific Antibodies

Native or recombinant PRO polypeptides may be purified by a variety of standard techniques in the art of protein purification. For example, pro-PRO polypeptide, mature PRO polypeptide, or pre-PRO polypeptide is purified by immunoaffinity chromatography using antibodies specific for the PRO polypeptide of interest. In general, an immunoaffinity column is constructed by covalently coupling the anti-PRO polypeptide antibody to an activated chromatographic resin.

Polyclonal immunoglobulins are prepared from immune sera either by precipitation with ammonium sulfate or by purification on immobilized Protein A (Pharmacia LKB Biotechnology, Piscataway, N.J.). Likewise, monoclonal antibodies are prepared from mouse ascites fluid by ammonium sulfate precipitation or chromatography on immobilized Protein A. Partially purified immunoglobulin is covalently attached to a chromatographic resin such as CnBr-activated SEPHAROSE™ (Pharmacia LKB Biotechnology). The antibody is coupled to the resin, the resin is blocked, and the derivative resin is washed according to the manufacturer's instructions.

Such an immunoaffinity column is utilized in the purification of PRO polypeptide by preparing a fraction from cells containing PRO polypeptide in a soluble form. This preparation is derived by solubilization of the whole cell or of a subcellular fraction obtained via differential centrifugation by the addition of detergent or by other methods well known in the art. Alternatively, soluble PRO polypeptide containing a signal sequence may be secreted in useful quantity into the medium in which the cells are grown.

A soluble PRO polypeptide-containing preparation is passed over the immunoaffinity column, and the column is washed under conditions that allow the preferential absorbance of PRO polypeptide (e.g., high ionic strength buffers in the presence of detergent). Then, the column is eluted under conditions that disrupt antibody/PRO polypeptide binding (e.g., a low pH buffer such as approximately pH 2-3, or a high concentration of a chaotrope such as urea or thiocyanate ion), and PRO polypeptide is collected.

Example 13

Drug Screening

This invention is particularly useful for screening compounds by using PRO polypeptides or binding fragment thereof in any of a variety of drug screening techniques. The PRO polypeptide or fragment employed in such a test may either be free in solution, affixed to a solid support, borne on a cell surface, or located intracellularly. One method of drug screening utilizes eukaryotic or prokaryotic host cells which are stably transformed with recombinant nucleic acids expressing the PRO polypeptide or fragment. Drugs are screened against such transformed cells in competitive binding assays. Such cells, either in viable or fixed form, can be used for standard binding assays. One may measure, for example, the formation of complexes between PRO polypeptide or a fragment and the agent being tested.

Alternatively, one can examine the diminution in complex formation between the PRO polypeptide and its target cell or target receptors caused by the agent being tested.

Thus, the present invention provides methods of screening for drugs or any other agents which can affect a PRO polypeptide-associated disease or disorder. These methods comprise contacting such an agent with an PRO polypeptide or fragment thereof and assaying (I) for the presence of a complex between the agent and the PRO polypeptide or fragment, or (ii) for the presence of a complex between the PRO polypeptide or fragment and the cell, by methods well known in the art. In such competitive binding assays, the PRO polypeptide or fragment is typically labeled. After suitable incubation, free PRO polypeptide or fragment is separated from that present in bound form, and the amount of free or uncomplexed label is a measure of the ability of the particular agent to bind to PRO polypeptide or to interfere with the PRO polypeptide/cell complex.

Another technique for drug screening provides high throughput screening for compounds having suitable binding affinity to a polypeptide and is described in detail in WO 84/03564, published on Sep. 13, 1984. Briefly stated, large numbers of different small peptide test compounds are synthesized on a solid substrate, such as plastic pins or some other surface. As applied to a PRO polypeptide, the peptide test compounds are reacted with PRO polypeptide and washed. Bound PRO polypeptide is detected by methods well known in the art. Purified PRO polypeptide can also be coated directly onto plates for use in the aforementioned drug screening techniques. In addition, non-neutralizing antibodies can be used to capture the peptide and immobilize it on the solid support.

This invention also contemplates the use of competitive drug screening assays in which neutralizing antibodies capable of binding PRO polypeptide specifically compete with a test compound for binding to PRO polypeptide or fragments thereof. In this manner, the antibodies can be used to detect the presence of any peptide which shares one or more antigenic determinants with PRO polypeptide.

Example 14

Rational Drug Design

The goal of rational drug design is to produce structural analogs of biologically active polypeptide of interest (i.e., a PRO polypeptide) or of small molecules with which they interact, e.g., agonists, antagonists, or inhibitors. Any of these examples can be used to fashion drugs which are more active or stable forms of the PRO polypeptide or which enhance or interfere with the function of the PRO polypeptide in vivo (cf., Hodgson, *Bio/Technology*, 9: 19-21(1991)).

In one approach, the three-dimensional structure of the PRO polypeptide, or of an PRO polypeptide-inhibitor complex, is determined by x-ray crystallography, by computer modeling or, most typically, by a combination of the two approaches. Both the shape and charges of the PRO polypeptide must be ascertained to elucidate the structure and to determine active site(s) of the molecule. Less often, useful information regarding the structure of the PRO polypeptide may be gained by modeling based on the structure of homologous proteins. In both cases, relevant structural information is used to design analogous PRO polypeptide-like molecules or to identify efficient inhibitors. Useful examples of rational drug design may include molecules which have improved activity or stability as shown by Braxton and Wells, *Biochemistry*, 31:7796-7801 (1992) or which act as inhibitors, agonists, or antagonists of native peptides as shown by Athauda et al., *J. Biochem.*, 113:742-746 (1993).

It is also possible to isolate a target-specific antibody, selected by functional assay, as described above, and then to solve its crystal structure. This approach, in principle, yields a pharmacore upon which subsequent drug design can be based. It is possible to bypass protein crystallography altogether by generating anti-idiotypic antibodies (anti-ids) to a functional, pharmacologically active antibody. As a mirror image of a mirror image, the binding site of the anti-ids would be expected to be an analog of the original receptor. The anti-id could then be used to identify and isolate peptides from banks of chemically or biologically produced peptides. The isolated peptides would then act as the pharmacore.

By virtue of the present invention, sufficient amounts of the PRO polypeptide may be made available to perform such analytical studies as X-ray crystallography. In addition, knowledge of the PRO polypeptide amino acid sequence provided herein will provide guidance to those employing computer modeling techniques in place of or in addition to x-ray crystallography.

Example 15

Pericyte c-Fos Induction (Assay 93)

This assay shows that certain polypeptides of the invention act to induce the expression of c-fos in pericyte cells and, therefore, are useful not only as diagnostic markers for particular types of pericyte-associated tumors but also for giving rise to antagonists which would be expected to be useful for the therapeutic treatment of pericyte-associated tumors. Induction of c-fos expression in pericytes is also indicative of the induction of angiogenesis and, as such, PRO polypeptides capable of inducing the expression of c-fos would be expected to be useful for the treatment of conditions where induced angiogenesis would be beneficial including, for example, wound healing, and the like. Specifically, on day 1, pericytes are received from VEC Technologies and all but 5 ml of media is removed from flask. On day 2, the pericytes are trypsinized, washed, spun and then plated onto 96 well plates. On day 7, the media is removed and the pericytes are treated with 100 µl of PRO polypeptide test samples and controls (positive control=DME+5% serum +/− PDGF at 500 ng/ml; negative control=protein 32). Replicates are averaged and SD/CV are determined. Fold increase over Protein 32 (buffer control) value indicated by chemiluminescence units (RLU) luminometer reading verses frequency is plotted on a histogram. Two-fold above Protein 32 value is considered positive for the assay. ASY Matrix: Growth media=low glucose DMEM=20% FBS+1× pen strep+1× fungizone. Assay Media=low glucose DMEM+5% FBS.

The following polypeptides tested positive in this assay: PRO982, PRO1160, PRO1187, and PRO1329.

Example 16

Chondrocyte Re-differentiation Assay (Assay 110)

This assay shows that certain polypeptides of the invention act to induce redifferentiation of chondrocytes, therefore, are expected to be useful for the treatment of various bone and/or cartilage disorders such as, for example, sports injuries and arthritis. The assay is performed as follows.

Porcine chondrocytes are isolated by overnight collagenase digestion of articulary cartilage of metacarpophalangeal joints of 4-6 month old female pigs. The isolated cells are then seeded at 25,000 cells/cm$^2$ in Ham F-12 containing 10% FBS and 4 µg/ml gentamycin. The culture media is changed every third day and the cells are then seeded in 96 well plates at 5,000 cells/well in 100 µl of the same media without serum and 100 µl of the test PRO polypeptide, 5 nM staurosporin (positive control) or medium alone (negative control) is added to give a final volume of 200 µl/well. After 5 days of incubation at 37° C., a picture of each well is taken and the differentiation state of the chondrocytes is determined. A positive result in the assay occurs when the redifferentiation of the chondrocytes is determined to be more similar to the positive control than the negative control.

The following polypeptide tested positive in this assay: PRO357.

Example 17

Identification of PRO Polypeptides that Stimulate TNF-α Release in Human Blood (Assay 128)

This assay shows that certain PRO polypeptides of the present invention act to stimulate the release of TNF-α in human blood. PRO polypeptides testing positive in this assay are useful for, among other things, research purposes where stimulation of the release of TNF-α would be desired and for the therapeutic treatment of conditions wherein enhanced TNF-α release would be beneficial. Specifically, 200 µl of human blood supplemented with 50 mM Hepes buffer (pH 7.2) is aliquoted per well in a 96 well test plate. To each well is then added 300 µl of either the test PRO polypeptide in 50 mM Hepes buffer (at various concentrations) or 50 mM Hepes buffer alone (negative control) and the plates are incubated at 37° C. for 6 hours. The samples are then centrifuged and 50 µl of plasma is collected from each well and tested for the presence of TNF-α by ELISA assay. A positive in the assay is a higher amount of TNF-α in the PRO polypeptide treated samples as compared to the negative control samples.

The following PRO polypeptides tested positive in this assay: PRO231; PRO357, PRO725, PRO1155, PRO1306, and PRO1419.

Example 18

Promotion of Chondrocyte Redifferentiation (Assay 129)

This assay is designed to determine whether PRO polypeptides of the present invention show the ability to induce the proliferation and/or redifferentiation of chondrocytes in culture. PRO polypeptides testing positive in this assay would be expected to be useful for the therapeutic treatment of various bone and/or cartilage disorders such as, for example, sports injuries and arthritis.

Porcine chondrocytes are isolated by overnight collagenase digestion of articular cartilage of the metacarpophalangeal joint of 4-6 month old female pigs. The isolated cells are then seeded at 25,000 cells/cm$^2$ in Ham F-12 containing 10% FBS and 4 µg/ml gentamycin. The culture media is changed every third day. On day 12, the cells are seeded in 96 well plates at 5,000 cells/well in 100 µl of the same media without serum and 100 µl of either serum-free medium (negative control), staurosporin (final concentration of 5 nM; positive control) or the test PRO polypeptide are added to give a final volume of 200 µl/well. After 5 days at 37° C., 22 µl of media containing 100 µg/ml Hoechst 33342 and 50 µg/ml 5-CFDA is added to each well and incubated for an additional 10 minutes at 37° C. A picture of the green fluorescence is taken for each well and the differentiation state of the chondrocytes is calculated by morphometric analysis. A positive result in the assay is obtained when the >50% of the PRO polypeptide treated cells are differentiated (compared to the background obtained by the negative control).

The following PRO polypeptides tested positive in this assay: PRO229, PRO1272, and PRO4405.

Example 19

Normal Human Dermal Fibroblast Proliferation (Assay 141)

This assay is designed to determine whether PRO polypeptides of the present invention show the ability to induce proliferation of human dermal fibroblast cells in culture and, therefore, function as useful growth factors.

On day 0, human dermal fibroblast cells (from cell lines, maximum of 12-14 passages) were plated in 96-well plates at 1000 cells/well per 100 microliter and incubated overnight in complete media [fibroblast growth media (FGM, Clonetics), plus supplements: insulin, human epithelial growth factor (hEGF), gentamicin (GA-1000), and fetal bovine serum (FBS, Clonetics)]. On day 1, complete media was replaced by basal media [FGM plus 1% FBS] and addition of PRO polypeptides at 1%, 0.1% and 0.01%. On day 7, an assessment of cell proliferation was performed by Alamar Blue assay followed by Crystal Violet. Results are expressed as % of the cell growth observed with control buffer.

The following PRO polypeptides stimulated normal human dermal fibroblast proliferation in this assay: PRO982, PRO357, PRO725, PRO1306, PRO1419, PRO214, PRO247, PRO337, PRO526, PRO363, PRO531, PRO1083, PRO840, PRO1080, PRO1478, PRO1134, PRO826, PRO1005, PRO809, PRO1071, PRO1411, PRO1309, PRO1025, PRO1181, PRO1126, PRO1186, PRO1192, PRO1244, PRO1274, PRO1412, PRO1286, PRO1330, PRO1347, PRO1305, PRO1273, PRO1279, PRO1340, PRO1338, PRO1343, PRO1376, PRO1387, PRO1409, PRO1474, PRO1917, PRO1760, PRO1567, PRO1887, PRO1928, PRO4341, PRO1801, PRO4333, PRO3543, PRO3444, PRO4322, PRO9940, PRO6079, PRO9836 and PRO10096.

The following PRO polypeptides inhibited normal human dermal fibroblast proliferation in this assay: PRO181, PRO229, PRO788, PRO1194, PRO1272, PRO1488, PRO4302, PRO4408, PRO5723, PRO5725, PRO7154, and PRO7425.

Example 20

Microarray Analysis to Detect Overexpression of PRO Polypeptides in Cancerous Tumors Nucleic acid microarrays, often containing thousands of gene sequences, are useful for identifying differentially expressed genes in diseased tissues as compared to their normal counterparts. Using nucleic acid microarrays, test and control mRNA samples from test and control tissue samples are reverse transcribed and labeled to generate cDNA probes. The cDNA probes are then hybridized to an array of nucleic acids immobilized on a solid support. The array is configured such that the sequence and position of each member of the array is known. For example, a selection of genes known to be expressed in certain disease states may be arrayed on a solid support. Hybridization of a labeled probe with a particular array member indicates that the sample from which the probe was derived expresses that gene. If the hybridization signal of a probe from a test (disease tissue) sample is greater than hybridization signal of a probe from a control (normal tissue) sample, the gene or genes overexpressed in the disease tissue are identified. The implication of this result is that an overexpressed protein in a diseased tissue is useful not only as a diagnostic marker for the presence of the disease condition, but also as a therapeutic target for treatment of the disease condition.

The methodology of hybridization of nucleic acids and microarray technology is well known in the art. In the present example, the specific preparation of nucleic acids for hybridization and probes, slides, and hybridization conditions are all detailed in U.S. Provisional Patent Application Ser. No. 60/193,767, filed on Mar. 31, 2000 and which is herein incorporated by reference.

In the present example, cancerous tumors derived from various human tissues were studied for PRO polypeptide-encoding gene expression relative to non-cancerous human tissue in an attempt to identify those PRO polypeptides which are overexpressed in cancerous tumors. Cancerous human tumor tissue from any of a variety of different human tumors was obtained and compared to a "universal" epithelial control sample which was prepared by pooling non-cancerous human tissues of epithelial origin, including liver, kidney, and lung. mRNA isolated from the pooled tissues represents a mixture of expressed gene products from these different tissues. Microarray hybridization experiments using the pooled control samples generated a linear plot in a 2-color analysis. The slope of the line generated in a 2-color analysis was then used to normalize the ratios of (test:control detection) within each experiment. The normalized ratios from various experiments were then compared and used to identify clustering of gene expression. Thus, the pooled "universal control" sample not only allowed effective relative gene expression determinations in a simple 2-sample comparison, it also allowed multi-sample comparisons across several experiments.

In the present experiments, nucleic acid probes derived from the herein described PRO polypeptide-encoding nucleic acid sequences were used in the creation of the microarray and RNA from a panel of nine different tumor tissues (listed below) were used for the hybridization thereto. A value based upon the normalized ratio:experimental ratio was designated as a "cutoff ratio". Only values that were above this cutoff ratio were determined to be significant. Table 8 below shows the results of these experiments, demonstrating that various PRO polypeptides of the present invention are significantly overexpressed in various human tumor tissues, as compared to a non-cancerous human tissue control or other human tumor tissues. As described above, these data demonstrate that the PRO polypeptides of the present invention are useful not only as diagnostic markers for the presence of one or more cancerous tumors, but also serve as therapeutic targets for the treatment of those tumors.

TABLE 8

| Molecule | is overexpressed in: | as compared to normal control: |
|---|---|---|
| PRO6004 | colon tumor | universal normal control |
| PRO4981 | colon tumor | universal normal control |
| PRO4981 | lung tumor | universal normal control |
| PRO7174 | colon tumor | universal normal control |
| PRO5778 | lung tumor | universal normal control |
| PRO5778 | breast tumor | universal normal control |
| PRO5778 | liver tumor | universal normal control |
| PRO4332 | colon tumor | universal normal control |
| PRO9799 | colon tumor | universal normal control |
| PRO9909 | colon tumor | universal normal control |
| PRO9917 | colon tumor | universal normal control |
| PRO9917 | lung tumor | universal normal control |
| PRO9917 | breast tumor | universal normal control |
| PRO9771 | colon tumor | universal normal control |
| PRO9877 | colon tumor | universal normal control |
| PRO9903 | colon tumor | universal normal control |
| PRO9830 | colon tumor | universal normal control |
| PRO7155 | colon tumor | universal normal control |
| PRO7155 | lung tumor | universal normal control |
| PRO7155 | prostate tumor | universal normal control |
| PRO9862 | colon tumor | universal normal control |
| PRO9882 | colon tumor | universal normal control |
| PRO9864 | colon tumor | universal normal control |
| PRO10013 | colon tumor | universal normal control |
| PRO9885 | colon tumor | universal normal control |
| PRO9879 | colon tumor | universal normal control |
| PRO10111 | colon tumor | universal normal control |
| PRO10111 | rectal tumor | universal normal control |
| PRO9925 | breast tumor | universal normal control |
| PRO9925 | rectal tumor | universal normal control |
| PRO9925 | colon tumor | universal normal control |
| PRO9925 | lung tumor | universal normal control |
| PRO9905 | colon tumor | universal normal control |
| PRO10276 | colon tumor | universal normal control |
| PRO9898 | colon tumor | universal normal control |
| PRO9904 | colon tumor | universal normal control |
| PRO19632 | colon tumor | universal normal control |
| PRO19672 | colon tumor | universal normal control |
| PRO9783 | colon tumor | universal normal control |
| PRO9783 | lung tumor | universal normal control |
| PRO9783 | breast tumor | universal normal control |
| PRO9783 | prostate tumor | universal normal control |
| PRO9783 | rectal tumor | universal normal control |
| PRO10112 | colon tumor | universal normal control |
| PRO10284 | colon tumor | universal normal control |
| PRO10100 | colon tumor | universal normal control |
| PRO19628 | colon tumor | universal normal control |
| PRO19684 | colon tumor | universal normal control |
| PRO10274 | colon tumor | universal normal control |
| PRO9907 | colon tumor | universal normal control |
| PRO9873 | colon tumor | universal normal control |
| PRO10201 | colon tumor | universal normal control |
| PRO10200 | colon tumor | universal normal control |
| PRO10196 | colon tumor | universal normal control |
| PRO10282 | lung tumor | universal normal control |
| PRO10282 | breast tumor | universal normal control |
| PRO10282 | colon tumor | universal normal control |
| PRO10282 | rectal tumor | universal normal control |
| PRO19650 | colon tumor | universal normal control |
| PRO21184 | lung tumor | universal normal control |
| PRO21184 | breast tumor | universal normal control |
| PRO21184 | colon tumor | universal normal control |
| PRO21201 | breast tumor | universal normal control |
| PRO21201 | colon tumor | universal normal control |
| PRO21175 | breast tumor | universal normal control |
| PRO21175 | colon tumor | universal normal control |
| PRO21175 | lung tumor | universal normal control |
| PRO21340 | colon tumor | universal normal control |
| PRO21340 | prostate tumor | universal normal control |
| PRO21384 | colon tumor | universal normal control |
| PRO21384 | lung tumor | universal normal control |
| PRO21384 | breast tumor | universal normal control |

Example 21

Tumor Versus Normal Differential Tissue Expression Distribution

Oligonucleotide probes were constructed from some of the PRO polypeptide-encoding nucleotide sequences shown in the accompanying figures for use in quantitative PCR amplification reactions. The oligonucleotide probes were chosen so as to give an approximately 200-600 base pair amplified fragment from the 3' end of its associated template in a standard PCR reaction. The oligonucleotide probes were employed in standard quantitative PCR amplification reactions with cDNA libraries isolated from different human tumor and normal human tissue samples and analyzed by agarose gel electrophoresis so as to obtain a quantitative determination of the level of expression of the PRO polypeptide-encoding nucleic acid in the various tumor and normal tissues tested. β-actin was used as a control to assure that equivalent amounts of nucleic acid was used in each reaction. Identification of the differential expression of the PRO polypeptide-encoding nucleic acid in one or more tumor tissues as compared to one or more normal tissues of the same tissue type renders the molecule useful diagnostically for the determination of the presence or absence of tumor in a subject suspected of possessing a tumor as well as therapeutically as a target for the treatment of a tumor in a subject possessing such a tumor. These assays provided the following results.

(1) the DNA94849-2960 molecule is significantly expressed in the following tissues: cartilage, testis, colon tumor, heart, placenta, bone marrow, adrenal gland, prostate, spleen aortic endothelial cells and uterus, and not significantly expressed in the following tissues: HUVEC.

(2) the DNA100272-2969 molecule is significantly expressed in cartilage, testis, human umblilical vein endothelial cells (HUVEC), colon tumor, heart, placenta, bone marrow, adrenal gland, prostate, spleen and aortic endothelial cells; and not significantly expressed in uterus. Among a panel of normal and tumor cells examined, the DNA100272-2969 was found to be expressed in normal esophagus, esophageal tumor, normal stomach, stomach tumor, normal kidney, kidney tumor, normal lung, lung tumor, normal rectum, rectal tumor, normal liver and liver tumor.

(3) the DNA108696-2966 molecule is highly expressed in prostate and also expressed in testis, bone marrow and spleen. The DNA108696-2966 molecule is expressed in normal stomach, but not expressed in stomach tumor. The DNA108696-2966 molecule is not expressed in normal kidney, kidney tumor, normal lung, or lung tumor. The DNA108696-2966 molecule is highly expressed in normal rectum, lower expression in rectal tumor. The DNA108696-2966 molecule is not expressed in normal liver or liver tumor. The DNA108696-2966 molecule is not expressed in normal esophagus, esophagial tumor, cartilage, HUVEC, colon tumor, heart, placenta, adrenal gland, aortic endothelial cells and uterus.

(4) the DNA119498-2965 molecule is significantly expressed in the following tissues: highly expressed in aortic endothelial cells, and also significantly expressed in cartilage, testis, HUVEC, colon tumor, heart, placenta, bone marrow, adrenal gland, prostate and spleen. It is not significantly expressed in uterus.

(5) the DNA119530-2968 molecule is expressed in the following tissues: normal esophagus and not expressed in the following tissues: esophageal tumors, stomach tumors, normal stomach, normal kidney, kidney tumor, normal lung, lung tumor, normal rectum, rectal tumors, normal liver or liver tumors.

(6) the DNA129794-2967 molecule is significantly expressed in testis and adrenal gland; and not significantly expressed in cartilage, human umblilical vein endothelial cells (HUVEC), colon tumor, heart, placenta, bone marrow, prostate, spleen, aortic endothelial cells and uterus.

(7) the DNA131590-2962 molecule is significantly expressed in the following tissues: bone marrow, adrenal gland, prostate, spleen, uterus, cartilage, testis, colon tumor, heart, and placenta, and not significantly expressed in the following tissues: HUVEC, and aortic endothelial cells.

(8) the DNA149995-2871 molecule is highly expressed in testis, and adrenal gland; expressed in cartilage, human umblilical vein endothelial cells (HUVEC), colon tumor, heart, prostate and uterus; weakly expressed in bone marrow, spleen and aortic endothelial cells; and not significantly expressed in placenta.

(9) the DNA167678-2963 molecule is significantly expressed in the following tissues: normal esophagus, esophagial tumor, highly expressed in normal stomach, stomach tumor, highly expressed in normal kidney, kidney tumor, expressed in lung, lung tumor, normal rectum, rectal tumor, weakly expressed in normal liver, and not significantly expressed in liver tumor.

(10) the DNA168028-2956 molecule is highly expressed in bone marrow; expressed in testis, human umblilical vein endothelial cells (HUVEC), colon tumor, heart, placenta, adrenal gland, prostate, spleen, aortic endothelial cells and uterus; and is weakly expressed in cartilage. Among a panel of normal and tumor samples examined, the DNA168028-2956 was found to be expressed in stomach tumor, normal kidney, kidney tumor, lung tumor, normal rectum and rectal tumor; and not expressed in normal esophagus, esophageal tumor, normal stomach, normal lung, normal liver and liver tumor.

(11) the DNA176775-2957 molecule is highly expressed in testis; expressed in cartilage and prostate; weakly expressed in adrenal gland, spleen and uterus; and not significantly expressed in human umblilical vein endothelial cells (HUVEC), colon tumor, heart, placenta, bone marrow and aortic endothelial cells.

(12) the DNA177313-2982 molecule is significantly expressed in prostate and aortic endothelial cells; and not significantly expressed in cartilage, testis, human umbilical vein endothelial cells (HUVEC), colon tumor, heart, placenta, bone marrow, adrenal gland, spleen and uterus. Among a panel of normal and tumor cells, the DNA177313-2982 molecule was found to be expressed in esophageal tumor but not in normal esophagus, normal stomach, stomach tumor, normal kidney, kidney tumor, normal lung, lung tumor, normal rectum, rectal tumor, normal liver and liver tumor.

SEQUENCE LISTING (246 sequences)

SEQ ID NO: 1 - DNA, 4834 bp, Homo Sapien
  unsure 3784: unknown base
gcagccctagcagggatggacatgatgctgttggtgcagggtgcttgttgctcgaaccagtggctggcggcggtgctcctcagcctgtgctgcctgctaccctcctgcctcccggctggacagagtgtggacttcccctgggcggccgtggacaacatgatggtcagaaaaggggacacggcggtgcttaggtgttatttggaagatggagcttcaaagggtgcctggctgaaccggtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaagttcctcctaagatatatgacatctcaaatgatatgaccgtcaatgaaggaaccaacgtcactcttacttgtttggccactgggaaaccagagccttccatttcttggcgacacatctccccatcagcaaaaccatttgaaaatggacaatatttggacatttatggaattacaagggaccaggctggggaatatgaatgcagtgcggaaaatgatgtgtcattcccagatgtgaggaaagtaaaagttgttgtcaactttgctcctactattcaggaaattaaatctggcaccgtgacccccggacgcagtggcctgataagatgtgaaggtgcaggtgtgccgcctccagcctttgaatggtacaaaggagagaagaagctcttcaatggccaacaaggaattattattcaaaattttagcacaagatccattctcactgttaccaacgtgacacaggagcacttcggcaattatacttgtgtggctgccaacaagctaggcacaaccaatgcgagcctgcctcttaaccctccaagtacagcccagtatggaattaccgggagcgctgatgttcttttctcctgctggtaccttgtgttgacactgtcctctttcaccagcatattctacctgaagaatgccattctacaataaattcaaagacccataaaaggcttttaaggattctctgaaagtgctgatggctggatccaatctggtacagtttgttaaaagcagcgtgggatataatcagcagtgcttacatggggatgatcgccttctgtagaattgctcattatgtaaatactttaattctactcttttttgattagctacattaccttgtgaagcagtacacattgtcctttttttaagacgtgaaagctctgaaattacttttagaggatattaattgtgatttcatgtttgtaatctacaacttttcaaaagcattcagtcatggtctgctaggttgcaggctgtagtttacaaaaacgaatattgcagtgaatatgtgattctttaaggctgcaatacaagcattcagttccctgtttcaataagagtcaatccacatttacaaagatgcatttttttcttttttgataaaaaagcaaataatattgccttcagattatttcttcaaaatataacacatatctagatttttctgctcgcatgatattcaggtttcaggaatgagccttgtaatataactggctgtgcagctctgcttctctttcctgtaagttcagcatgggtgtgccttcatacaataatatttttctctttgtctccaactaatataaaatgttttgctaaatcttacaatttgaaagtaaaaataaaccagagtgatcaagttaaaccatacactatctctaagtaacgaaggagctattggactgtaaaaatctcttcctgcactgacaatggggtttgagaattttgccccacactaactcagttcttgtgatgagagacaatttaataacagtatagtaaatataccatatgatttctttagttgtagctaaatgttagatccaccgtgggaaatcattccctttaaaatgacagcacagtccactcaaaggattgcctagcaatacagcatcttttcctttcactagtccaagccaaaaattttaagatgatttgtcagaaagggcacaaagtcctatcacctaatattacaagagttggtaagcgctcatcattaattttattttgtggcagctaagttagtatgacagaggcagtgctcctgtggacaggagcattttgcatattttccatctgaaagtatcactcagttgatagtctggaatgcatgttatatattttaaaacttccaaaatatattataacaaacattctatatcggtatgtagcagaccaatctctaaaatagctaattcttcaataaaatctttctatatagccatttcagtgcaaacaagtaaaatcaaaaaagaccatcctttatttttccttacatgatatatgtaagatgcgatcaaataaagacaaaacaccagtgatgagaatatcttaagataagtaattatcaaattattgtgaatgttaaattatttctactataaagaagcaaaactacatttttgaaggaaaatgctgttactctaacattaatttacaggaatagtttgatggtttcactctttactaaagaaaggccatcaccttgaaagccattttacaggtttgatgaagttaccaatttcagtacacctaaatttctacaaatagtccccttttacaagttgtaacaacaaagaccctataataaaattagatacaagaaattttgcagtggttatacatatttgagatatctagtatgttgccctagcagggatggcttaaaaactgtgattttttttcttcaagtaaaacttagtcccaaagtacatcataaatcaattttaattagaaaaatgaatcttaaatgaggggacataagtatactctttccacaaaatggcaataataaggcataaagctagtaaatctactaactgtaataaatgtatgacattattttgattgatacattaaaaaagagtttttagaacaaatatggcatttaactttattatttatttgcttttaagaaatattctttgtggaattgttgaataaactataaaatattattttgtattgcagctttaaagtggcacactccataataatctacttactagaaatagtggtgctaccacaaaaaatgttaaccatcagtaccattgtttgggagaaagaaacagatcaagaatgcatattattcagtgaccgctttcctagagttaaaatacctcctctttgtaaggtttgtaggtaaattgaggtataaactatggatgaaccaaataattagttcaaagtgttgtcatgattccaaatttgtggagtctggtgtttttaccatagaatgtgacagaagtacagtcatagctcagtagctatatgtatttgcctttatgttagaagagactttcttgagtgacatttttaaatagaggaggtattcactatgtttttctgtatcacagcagcattcctagtccttaggccctcggacagagtgaaatcatgagtatttatgagttcaatattgtcaaataaggctacagtatttgcttttttgtgtgaatgtattgcatataatgttcaagtagatgattttacatttatggacatataaaatgtctgattaccccattttatcagtcctgactgtacaagattgttgcaatttcagaatagcagttttataaattgatttatcttttaatctataacaatttgtgttagctgttcatttcaggantatattttctacaagttccacttgtgggactccttttgttgcccctatttttttttaaagaaggaagaaagaaaaataagtagcagtttaaaaatgagaatggagagaaaagaaaaagaatgaaaaggaaaggcagtaaagagggaaaaaaaaggaaggatggaaggaatgaaggaaggaagggaggaaggggagaaggtaggaagaaagaaaggatgagagggaaggaagaatcagagtattagggtagttaacttacacatttgcattcttagtttaactgcaagtggtgtaactatgtttttcaatgatcgcatttgaaacataagtcctattataccattaagttcctattatgcagcaattatataataaaaagtactgcccaagttatagtaatgtgggtgtttttgagacactaaaagatttgagagggagaatttcaaacttaaagccacttttggggggtttataacttaactgaaaaattaatgcttcatcataacatttaagctatatctagaaagtagactggagaactgagaaaattacccaggtaattcagggaaaaaaaaaaatatatatatatataaatacccctacatttgaagtcagaaaactctgaaaaactgaattatcaaagtcaatcatctataatgatcaaatttactgaacaattgttaatttatccattgtgcttagctttgtgacacagccaaaagttacctatttaatcttttcaataaaaattgttttttgaaatccagaaatgatttaaaaagaggtcaggtttttaactatttattgaagtatgtggatgtacagtatttcaatagatatgaatatgaataaatggtatgccttaagattctttgaatatgtatttactttaaagactggaaaaagctcttcctgtcttttagtaaaacatccatatttcataacctgatgtaaaatatgttgtactgtttccaataggtgaatataaactcagtttatcaattaaaaaaaaaaaaaaaaaaaaaaaaaaaaaaaaaaaaaaaaaaaaaa

SEQ ID NO: 2 - protein, 354 aa, Homo Sapien
MDMMLLVQGACCSNQWLAAVLLSLCCLLPSCLPAGQSVDFPWAAVDNMMVRKGDTAVLRCYLEDGASKGAWLNRSSIIFAGGDKWSVDPRVSISTLNKRDYSLQIQNVDVTDDGPYTCSVQTQHTPRTMQVHLTVQVPPKIYDISNDMTVNEGTNVTLTCLATGKPEPSISWRHISPSAKPFENGQYLDIYGITRDQAGEYECSAENDVSFPDVRKVKVVVNFAPTIQEIKSGTVTPGRSGLIRCEGAGVPPPAFEWYKGEKKLFNGQQGIIIQNFSTRSILTVTNVTQEHFGNYTCVAANKLGTTNASLPLNPPSTAQYGITGSADVLFSCWYLVLTLSSFTSIFYLKNAILQ

SEQ ID NO: 3 - DNA, 2506 bp, Homo Sapien
cactgcccgtccgctcttcagcagccggtcgcgggcggtggaaaagcgagtgaagagagcgcgacggcggcggcggcggcggcgcagctattgctggacggccagtgggagagcgaggcctgagcctctgcgtctaggatcaaaatggtttcaatcccagaatactatgaaggcaagaacgtcctcctcacaggagctaccggttttctagggaaggtgcttctggaaaagttgctgaggtcttgtcctaaggtgaattcagtatatgttttggtgaggcagaaagctggacagacaccacaagagcgagtggaagaagtccttagtggcaagctttttgacagattgagagatgaaaatccagattttagagagaaaattatagcaatcaacagcgaactcacccaacctaaactggctctcagtgaagaagataaagaggtgatcatagattctaccaatattatattccactgtgcagctacagtaaggtttaatgaaaatttaagagatgctgttcagttaaatgtgattgcaacgcgacagcttattctccttgcacaacaaatgaagaatctggaagtgttcatgcatgtatcaacagcatatgcctactgtaatcgcaagcatattgatgaagtagtctatccaccacctgtggatcccaagaagctgattgattctttagagtggatggatgatggcctagtaaatgatatcacgccaaaattgataggagacagacctaatacatacatatacacaaaagcattggcagaatatgttgtacaacaagaaggagcaaaactaaatgtggcaattgtaaggccatcgattgttggtgccagttggaaagaaccttttccaggatggattgataactttaatggaccaagtggtctctttattgcggcagggaaaggaattcttcgaacaatacgtgcctccaacaatgcccttgcagatcttgttcctgtagatgtagttgtcaacatgagtcttgcggcagcctggtattccggagttaatagaccaagaaacatcatggtgtataattgtacaacaggcagcactaatcctttccactggggtgaagttgagtaccatgtaatttccactttcaagaggaatcctctcgaacaggccttcagacggcccaatgtaaatctaacctccaatcatcttttatatcattactggattgctgtaagccataaggccccagcattcctgtatgatatctacctcaggatgactggaagaagcccaaggatgatgaaaacaataactcgtcttcacaaagctatggtgtttcttgaatatttcacaagtaattcttgggtttggaatactgagaatgtcaatatgttaatgaatcaactaaaccctgaagataaaaagaccttcaatattgatgtacggcagttacattgggcagaatatatagagaactactgcttgggaactaagaagtacgtattgaatgaagaaatgtctggcctccctgcagccagaaaacatctgaacaagttgcggaatatacgttatggttttaatactatccttgtgatcctcatctggcgcatttttattgcaagatcacaaatggcaagaaatatctggtactttgtggttagtctgtgttacaagtttttgtcatacttccgagcatccagcactatgagatactgaagaccaaggattcagcattagaacatctatacatatggtgatctaaatgtacaaaatgtaaaatgtataagtcatctcactttttgtcaagacattaaaccatcttagatcggagtgtgaagtaaattatggtatattttatgtaacattttaatgtttatgctcataaaacttagtgaacacactgtgttatgccagctcaaatctacagtagccaccaaaaccatgacttaatattttgagccctagaagaaaggggtgtgctgaggacaagagtggggaaataggaacactgaccagtataactgtgcaattctggaacatattaattaaaataatatgccttaacatatagtgaatttctaattctaatgttcagtgcaatggaagacatttatttggacagtatactagcaaagttggtagatatttgattcttcattttttgtttttttcattagttgaagtgggttttagttttgtttaaaattataaccagcgtattttcacatcattctgtaagttaaatgatatcaaacatgaaagagatgttctcatttttctttttctgattaaacgtctgatgcatatcatttttctataagtaatcagttgcttttaaaatcagaaggctatattattctaatgaccctattcgatctaaatgggtttgagaatccatatcagcaacatacgtgttttttgacagaaagtgaaaacaaattccgtaaaactgttagtatcaaaaagaataggaatacagttttcttttccacattatgatcaaataaaaatcttgtgagattgttaaaaa

SEQ ID NO: 4 - protein, 515 aa, Homo Sapien
MVSIPEYYEGKNVLLTGATGFLGKVLLEKLLRSCPKVNSVYVLVRQKAGQTPQERVEEVLSGKLFDRLRDENPDFREKIIAINSELTQPKLALSEEDKEVIIDSTNIIFHCAATVRFNENLRDAVQLNVIATRQLILLAQQMKNLEVFMHVSTAYAYCNRKHIDEVVYPPPVDPKKLIDSLEWMDDGLVNDITPKLIGDRPNTYIYTKALAEYVVQQEGAKLNVAIVRPSIVGASWKEPFPGWIDNFNGPSGLFIAAGKGILRTIRASNNALADLVPVDVVVNMSLAAAWYSGVNRPRNIMVYNCTTGSTNPFHWGEVEYHVISTFKRNPLEQAFRRPNVNLTSNHLLYHYWIAVSHKAPAFLYDIYLRMTGRSPRMMKTITRLHKAMVFLEYFTSNSWVWNTENVNMLMNQLNPEDKKTFNIDVRQLHWAEYIENYCLGTKKYVLNEEMSGLPAARKHLNKLRNIRYGFNTILVILIWRIFIARSQMARNIWYFVVSLCYKFLSYFRASSTMRY

SEQ ID NO: 5 - DNA, 1759 bp, Homo Sapien
cgatgccggcggtcagtggtccaggtcccttattctgccttctcctcctgctcctggacccccacagccctgagacggggtgtcctcctctacgcaggtttgagtacaagctcagcttcaaaggcccaaggctggcattgcctggggctggaatacccttctggagccatcatggagacgccatcctgggcctggaggaagtgcggctgacgccatccatgaggaaccggagtggcgccgtgtggagcagggcctctgtccccttctctgcctgggaagtagaggtgcagatgagggtgacgggactggggcgccggggagcccagggcatggccgtgtggtacacccggggcaggggccatgtaggctctgtccttggggggctggcttcgtgggacggcatcgggatcttctttgactctccggcagaggatactcaggacagtcctgccatccgtgtgctggccagcgacgggcacatcccctctgagcagcctggggatggagctagccaagggctgggctcctgtcattgggacttccggaaccggccacactccttcagagcacggatcacctactgggggcagaggctgcgcatgtccttgaacagtggcctcactcccagtgatccaggtgagttctgtgtggatgtggggcccctgcttttggtccctggaggtttctttggggtctcagcagccaccggcaccctggcaggtgaggatcccactggacaggttccccctcagcccttcctggagatgcagcagctccgcctggcgaggcagctggaagggctgtgggcaaggctgggcttgggcaccagggaggatgtaactccaaaatcagactctgaagctcaaggagaaggggaaaggctctttgacctggaggagacgctgggcagacaccgccggatcctgcaggctctgcggggtctctccaagcagctggcccaggctgagagacaatggaagaagcagctggggcccccaggccaagccaggcctgacggaggctgggccctggatgcttcctgccagattccatccaccccagggaggggtggccacctctccatgtcactcaataaggactctgccaaggtcggtgccctgctccatggacagtggactctgctccaggccctgcaagagatgagggatgcagctgtccgcatggctgcagaagcccaggtctcctacctgcctgtgggcattgagcatcatttcttagagctggaccacatcctgggcctcctgcaggaggagcttcggggcccggcgaaggcagcagccaaggccccccgcccacctggccagcccccaagggcctcctcgtgcctgcagcctggcatcttcctgttctacctcctcattcagactgtaggcttcttcggctacgtgcacttcaggcaggagctgaacaagagccttcaggagtgtctgtccacaggcagccttcctctgggtcctgcaccacacacccccagggccctggggattctgaggaggcagcctctccctgccagcatgcctgcctgacccacctcagagcctgctttgcatcactgggaagcaggcagtgtcttgggtgggggcttggtcagtatcctctccgtctgggtgcccagctcccacgcacacctgagctttcggcatgctcccacctcgttaaaggtgatttccctctccccaaaaaaaaaaaaaaaaaaaaaaaaaaaaaaaaaaaaaaaaaaaaaaaaaaaaaaaaaaaa

SEQ ID NO: 6 - protein, 514 aa, Homo Sapien [sequence omitted]

SEQ ID NO: 7 - DNA, 3010 bp, Homo Sapien
gcccccagcatggcttggcagggctggcccgcggcgtggcagtgggtcgccggctgctggctcctcctcgtccttgtcctcgtcctacttgtgagcccccgcggctgccgagcgcggcggggcctccgcggtctgctcatggcgcacagccagcggctgctcttccgaatcgggtacagcctgtacacccgcacctggctcgggtacctcttctaccgacagcagctgcgcagggctcggaatcgctaccctaaaggccactcgaaaacccagccccgcctcttcaatggagtgaaggtgcttcccatccctgtcctctcggacaactacagctacctcatcatcgacacccaggcccagctggctgtggctgtggacccttcagaccctcgggctgtgcaggcttccattgaaaaggaaggggtcaccttggtcgccattctgtgtactcacaagcactgggaccacagtggagggaaccgtgacctcagccggcggcaccgggactgtcgggtgtacgggagccctcaggacggcatcccctacctcacccatcccctgtgtcatcaagatgtggtcagcgtgggacggcttcagatccgggccctggctacacctggccacacacaaggccatctggtctacctactggatggggagccctacaagggtccctcctgcctcttctcaggggacctgctcttcctctctggctgtgggcggacctttgagggcaatgcagagaccatgctgagctcactggacactgtgctggggctaggggatgacacccttctgtggcctggtcatgagtatgcagaggagaacctgggctttgcaggtgtggtggagcccgagaacctggcccgggagaggaagatgcagtgggtgcagcggcagcggctggagcgcaagggcacgtgcccatctaccctgggagaggagcgctcctacaacccgttcctgagaacccactgcctggcgctacaggaggctctggggccggggccgggccccactggggatgatgactactcccgggcccagctcctggaagagctccgccggctgaaggatatgcacaagagcaagtgatgcccccagcgcccccagcccagcccactccccgcatggggaggccgccaccaccaacacctcatcatccttctcatcgctaacaccaccacctccatcggcacccaagcgggcatcatccccccacactgctcaggggaggggagggatcaggcgatgagactgtgaggccaaaagaagggggcctgttggaggctgggaaccccgcagcgcgaggctgcctcatcaacggcaagaggaaaggaggggtctcgggacatctccagaccctaccaactgggagggtcccctcctccttccctactcctgggacggcagcaaggacatgggggctgctgttagcttctccgtcaggaggcctcatctcactgtagccctggaacccagggtccatcttgcccttcccccatccatggttgggaaagaagctcagcccctcacagtggcctcaagtgtgatgccttacaaaagcaccactcagatgggcagctggactctggtgtcctgagactctgccctcttcccacagcctccctgccccacccatccctgcaaagccatttttcagacagagccattcctaagaacactgaagggctggaatgctggctggccactctctgcctcagtggcctccctacagcctggaagaaggagggtcctgattgccaaggaaacctcctcattgggctaaggagacactggagtctggagtgtggagccccacagtcttgcaggtcacatgctctccttgcacatctggcctggttgtacccactggcctctgcctctgccctgggccaaaagggcccctccttgccaggggagagacagccacggtcctctttggccgatgctgtattctcattttggcccttgttcttaggcccgtctgcccgccctcctccatctaacctttcctgttttatccgcagcccttttcttctttgagttagtaaagatttattctgtaacctgacactcatctggccctttgcagtttgccagccatattcccatgtgatttcccactggatccaggcccccatccggctggcaggagggggctctgacgtacaggttggaaatcagaagtctgtgagagcgcgggagtgcatggcagctctgggtcccagacctggcccgacccctctgcttcacctccagctctgctgctcctctactcttgggtcgagatccctttggagccacagcgaggaaccctgtggtcctcaggcaggtgtaccttgagtcagccaggagccctcttttcctgtgtcaaagcctgccctcgggctctgctcacctctggtgaccctccaagatgcccctgccctcagtttcccctcatgatctggcctctgcccccttctctagccacagcctctagtacactttagcaataccaccagactagttagagttccccactcaccaagcaagacatgcagtttcatgcctctgtgccttcgctcatgctgtttcttccgactggaatgccttcccctgctcctcctgccttgtctgcctggcaagttcatctctcacgatcccctcaaaggccccctcctccaggaaggcaacccctgtgcccctcccctccaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 8 - protein, 361 aa, Homo Sapien
MAWQGWPAAWQWVAGCWLLLVLVLVLLVSPRGCRARRGLRGLLMAHSQRLLFRIGYSLYTRTWLGYLFYRQQLRRARNRYPKGHSKTQPRLFNGVKVLPIPVLSDNYSYLIIDTQAQLAVAVDPSDPRAVQASIEKEGVTLVAILCTHKHWDHSGGNRDLSRRHRDCRVYGSPQDGIPYLTHPLCHQDVVSVGRLQIRALATPGHTQGHLVYLLDGEPYKGPSCLFSGDLLFLSGCGRTFEGNAETMLSSLDTVLGLGDDTLLWPGHEYAEENLGFAGVVEPENLARERKMQWVQRQRLERKGTCPSTLGEERSYNPFLRTHCLALQEALGPGPGPTGDDDYSRAQLLEELRRLKDMHKSK

SEQ ID NO: 9 - DNA, 872 bp, Homo Sapien
gctgacaatccccttgacgttctatcccggaagctccacctggggcccaatgttgggcgtgatgttcctcgcctgtctctgcctggaaaactggtcttcccaagctccactggcagccacttctccatgttgggcatcggagacatcgttatgcctggtctcctactatgctttgtccttcgctatgacaactacaaaaagcaagccagtggggactcctgtggggcccctggacctgccaacatctccgggcgcatgcagaaggtctcctactctcactgcaccctcatcggatactttgtaggcctgctcactgctactgtggcgtctcgcattcaccgggccgcccagcccgcccttctctatttggtgccatttactttattgccactcctcacgatggcctatttaaagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcattgaaagggagctcgtttgcaggagagaggtgctggagccctgtttggttccttctcttcctgcggatgtagaggtggggccccttccaagagggacaggcctctccccagcgcgccttcctcccacgtttttatggatctgcaccagactgttaccttctgggggagatggagatttgactgtttaaaaactgaaaacagcgaggagtctttctagaacttttgaacactaaaaggatgaaaaaattagc

SEQ ID NO: 10 - protein, 108 aa, Homo Sapien
MMDHVESDQMAVIVLFSQLMVCFLLELAWYSEMYLCLRNCRVTGFGIERELVCRREVLEPCLVPSLPADVEVGPLPRGTGLSPARLPPTFLWICTRLLPSGGDGDLTV

SEQ ID NO: 11 - DNA, 1739 bp, Homo Sapien
tcgcacactggtggcttcagaagaaattctcaacacctagctcgccagagagtctatgtatgggattgaacaatctgtaaactaaaggatcctaatcatgaaaataagtatgataaattataagtcactattggcactgttgtttatattagcctcctggatcatttttacagttttccagaactccacaaaggtttggtctgctctaaacttatccatctccctccattactggaacaactccacaaagtccttattccctaaaacaccactgatatcattaaagccactaacagagactgaactcagaataaaggaaatcatagagaaactagatcagcagatcccacccagacctttcacccacgtgaacaccaccaccagcgccacacatagcacagccaccatcctcaaccctcgagatacgtactgcaggggagaccagctgcacatcctgctggaggtgagggaccacttgggacgcaggaagcaatatggcggggatttcctgagggccaggatgtcttccccagcgctgatggcaggtgcttcaggaaaggtgactgacttcaacaacggcacctacctggtcagcttcactctgttctgggagggccaggtctctctgtctctgctgctcatccaccccagtgaaggggtgtcagctctctggagtgcaaggaaccaaggctatgacagggtgatcttcactggccagtttgtcaatggcacttcccaagtccactctgaatgtggcctgatcctaaacacaaatgctgaattgtgccagtacctggacaacagagaccaagaaggcttctactgtgtgaggcctcaacacatgccctgtgctgcactcactcacatgtattctaagaacaagaaagtttcttatcttagcaaacaagaaaagagcctctttgaaaggtcaaatgtgggtgtagagattatggaaaaattcaatacaattagtgtctccaaatgcaacaaagaaacagttgcaatgaaagagaaatgcaagtttggaatgacatccacaatccccagtgggcatgtctggagaaacacatggaatcctgtctcctgtagtttggctacagtcaaaatgaaggaatgcctgagaggaaaactcatatacctaatgggagattccacgatccgccagtggatggaatacttcaaagccagtatcaacacactgaagtcagtggatctgcatgaatctggaaaattgcaacaccagcttgctgtggatttggataggaacatcaacatccagtggcaaaaatattgttatcccttgataggatcaatgacctattcagtcaaagagatggagtacctcacccgggccattgacagaactggaggagaaaaaaatactgtcattgttatttccctgggccagcatttcagaccctttcccattgatgtttttatccgaagggccctcaatgtccacaaagccattcagcatcttcttctgagaagcccagacactatggttatcatcaaaacagaaaacatcagggagatgtacaatgatgcagaaagatttagtgactttcatggttacattcaatatctcatcataaaggacattttccaggatctcagtgtgagtatcattgatgcctgggatataacaattgcatatggcacaaataatgtacacccacctcaacatgtagtcggaaatcagattaatatattattaaactatatttgttaaataacaa

SEQ ID NO: 12 - protein, 544 aa, Homo Sapien
MKISMINYKSLLALLFILASWIIFTVFQNSTKVWSALNLSISLHYWNNSTKSLFPKTPLISLKPLTETELRIKEIIEKLDQQIPPRPFTHVNTTTSATHSTATILNPRDTYCRGDQLHILLEVRDHLGRRKQYGGDFLRARMSSPALMAGASGKVTDFNNGTYLVSFTLFWEGQVSLSLLLIHPSEGVSALWSARNQGYDRVIFTGQFVNGTSQVHSECGLILNTNAELCQYLDNRDQEGFYCVRPQHMPCAALTHMYSKNKKVSYLSKQEKSLFERSNVGVEIMEKFNTISVSKCNKETVAMKEKCKFGMTSTIPSGHVWRNTWNPVSCSLATVKMKECLRGKLIYLMGDSTIRQWMEYFKASINTLKSVDLHESGKLQHQLAVDLDRNINIQWQKYCYPLIGSMTYSVKEMEYLTRAIDRTGGEKNTVIVISLGQHFRPFPIDVFIRRALNVHKAIQHLLLRSPDTMVIIKTENIREMYNDAERFSDFHGYIQYLIIKDIFQDLSVSIIDAWDITIAYGTNNVHPPQHVVGNQINILLNYIC

SEQ ID NO: 13 - DNA, 1893 bp, Homo Sapien
gcaaagagaagactgaaagacaaacctgggtgcagccagagaggtccagatagatgagcttgtggcatccattccccaagttcagcctagggactccacgtaccccagctgggtctcattgttccagaactgcattagttaagattacccagacttggatttcaaaggaatactttcattgttccgtctgtaacacgaagtaattggggccagctggatgtcaggatgcgtgtggttaccattgtaatcttgctctgcttttgcaaagcggctgagctgcgcaaagcaagcccaggcagtgtgagaagccgagtgaatcatggccgggcgggtggaggccggagaggctccaacccggtcaaacgctacgcaccaggcctcccgtgtgacgtgtacacatatctccatgagaaatacttagattgtcaagaaagaaaattagtttatgtgctgcctggttggcctcaggatttgctgcacatgctgctagcaagaaacaagatccgcacattgaagaacaacatgttttccaagtttaaaaagctgaaaagcctggatctgcagcagaatgagatctctaaaattgagagtgaggcgttctttggtttaaacaaactcaccaccctcttactgcagcacaaccagatcaaagtcttgacggaggaagtgttcatttacacacctctcttgagctacctgcgtctttatgacaacccctggcactgtacttgtgagatagaaacgcttatttcaatgttgcagattcccaggaaccggaatttggggaactacgccaagtgtgaaagtccacaagaacaaaaaaataaaaaactgcggcagataaaatctgaacagttgtgtaatgaagaaaaggaacaattggacccgaaaccccaagtgtcagggagacccccagtcatcaagcctgaggtggactcaactttttgccacaattatgtgtttcccatacaaacactggactgcaaaaggaaagagttgaaaaaagtgccaaacaacatccctccagatattgttaaacttgacttgtcatacaataaaatcaaccaacttcgacccaaggaatttgaagatgttcatgagctgaagaaattaaacctcagcagcaatggcattgaattcatcgatcctgccgcttttttagggctcacacatttagaagaattagatttatcaaacaacagtctgcaaaactttgactatggcgtattagaagacttgtattttttgaaactcttgtggctcagagataacccttggagatgtgactacaacattcactacctctactactggttaaagcaccactacaatgtccattttaatggcctggaatgcaaaacgcctgaagaatacaaaggatggtctgtgggaaaatatattagaagttactatgaagaatgccccaaagacaagttaccagcatatcctgagtcatttgaccaagacacagaagatgatgaatgggaaaaaaaacatagagatcacaccgcaaagaagcaaagcgtaataattactatagtaggataaggtagaaattgttctgattgtaattagttttgtattttctatactggtgttagaaaacatatgtttacatttgattaactgtgttgcctatttatgcagggtaatccagctaaaggaagctttctttaattataagtattattgtgactattatagtaatcaagagaatgctatcatcctgcttgcctgtccatttgtggaacagcatctggtgatatgcaattccacactggtaacctgcagcagttgggtcctaatgatggcattagactttcataatgtcctgtataaatgtttttactgcttttagaaaataaagaaaaaaaacttggttcatgtttaaaa

SEQ ID NO: 14 - protein, 440 aa, Homo Sapien
MRVVTIVILLCFCKAAELRKASPGSVRSRVNHGRAGGGRRGSNPVKRYAPGLPCDVYTYLHEKYLDCQERKLVYVLPGWPQDLLHMLLARNKIRTLKNNMFSKFKKLKSLDLQQNEISKIESEAFFGLNKLTTLLLQHNQIKVLTEEVFIYTPLLSYLRLYDNPWHCTCEIETLISMLQIPRNRNLGNYAKCESPQEQKNKKLRQIKSEQLCNEEKEQLDPKPQVSGRPPVIKPEVDSTFCHNYVFPIQTLDCKRKELKKVPNNIPPDIVKLDLSYNKINQLRPKEFEDVHELKKLNLSSNGIEFIDPAAFLGLTHLEELDLSNNSLQNFDYGVLEDLYFLKLLWLRDNPWRCDYNIHYLYYWLKHHYNVHFNGLECKTPEEYKGWSVGKYIRSYYEECPKDKLPAYPESFDQDTEDDEWEKKHRDHTAKKQSVIITIVG

SEQ ID NO: 15 - DNA, 1524 bp, Homo Sapien
gcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagaga

SEQ ID NO: 16 - protein, 141 aa, Homo Sapien
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 17 - DNA, 1402 bp, Homo Sapien
cgcaaagccgccctcggggcgctcatggcgggacgcctcctgggaaaggctttagccgcggtgtctctctctctggccttggcctctgtgactatcaggtcctcgcgctgccgcggcatccaggcgttcagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagtgaaagtaatttttctcccaagtttaacgaaaaggatgggcatgttgagagaaagagcaagaatggcctgtatgagattgaaaatggaagaccgagaaatcctgcaggacggactggactggtgggccgggggcttttggggcgatggggcccaaatcacgctgcagatcccattataaccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtgatatataagggatatgttgatgatcctcgaaacactgataatgcatggatggagacagaagctgtgaactaccatgacgaaacaggtgagataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctata

SEQ ID NO: 18 - protein, 350 aa, Homo Sapien
MAGRLLGKALAAVSLSLALASVTIRSSRCRGIQAFRNSFSSSWFHLNTNVMSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIMDNLMLEAGDDAGKVKWVDINDKLKLYASHSQFIKLVAEKRDAHWSEDSEADCHAL

SEQ ID NO: 19 - DNA, 2138 bp, Homo Sapien
cgagggctcctgctggtactgtgttcgctgctgcacagcaaggccctgccacccaccttcaggccatgcagccatgttccgggagccctaattgcacagaagcccatggggagctccagactggcagccctgctcctgcctctcctcctcatagtcatcgacctctctgactctgctgggattggctttcgccacctgccccactggaacacccgctgtcctctggcctcccacacggatgacagtttcactggaagttctgcctatatcccttgccgcacctggtgggccctcttctccacaaagccttggtgtgtgcgagtctggcactgttcccgctgtttgtgccagcatctgctgtcaggtggctcaggtcttcaacggggcctcttccacctcctggtgcagaaatccaaaaagtcttccacattcaagttctataggagacacaagatgccagcacctgctcagaggaagctgctgcctcgtcgtcacctgtctgagaagagccatcacatttccatcccctccccagacatctcccacaagggacttcgctctaaaaggacccaaccttcggatccagagacatgggaaagtcttcccagattggactcacaaaggcatggaggacccgagttctcctttgatttgctgcctgaggcccgggctattcgggtgaccatatcttcaggccctgaggtcagcgtgcgtctttgtcaccagtgggcactggagtgtgaagagctgagcagtccctatgatgtccagaaaattgtgtctgggggccacactgtagagctgccttatgaattccttctgccctgtctgtgcatagaggcatcctacctgcaagaggacactgtgaggcgcaaaaaatgtcccttccagagctggccagaagcctatggctcggacttctggaagtcagtgcacttcactgactacagccagcacactcagatggtcatggccctgacactccgctgcccactgaagctggaagctgccctctgccagaggcacgactggcataccctttgcaaagacctcccgaatgccacggctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggcccggggctcaagcccagtgtcactagacctcatcattcccttcctgaggccagggtgctgtgtcctggtgtggcggtcagatgtccagtttgcctggaagcacctcttgtgtccagatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggcttgaacgagaggccgcccgacttgcagacctaggttgagcagagctccaccgcagtcccgggtgtct

SEQ ID NO: 20 - protein, 667 aa, Homo Sapien
MGSSRLAALLLPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLVWRSDVQFAWKHLLCPDVSYRHLGLLILALLALLTLLGVVLALTCRRPQSGPGPARPVLLLHAADSEAQRRLVGALAELLRAALGGGRDVIVDLWEGRHVARVGPLPWLWAARTRVAREQGTVLLLWSGADLRPVSGPDPRAAPLLALLHAAPRPLLLLAYFSRLCAKGDIPPPLRALPRYRLLRDLPRLLRALDARPFAEATSWGRLGARQRRQSRLELCSRLEREAARLADLG

SEQ ID NO: 21 - DNA, 2714 bp, Homo Sapien
cggctcgaggccctttgtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacatcgcggccggcgtgtggatgatcatgaatgccttcatcttgttgctgtgtgaggcgcccttctgctgccagttcatcgagtttgcaaacacagtggcggagaaggtggaccggctgcgctcctggcagaaggctgtcttctactgcgggatggcggtcgttcccatcgtcatcagcctgaccctgaccacgctgctgggcaacgccatcgcctttgctacgggggtgctgtacggactctctgctctgggcaaaaagggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggcccctaggttctacccatcaccccccgcccctgctggccttggtgctaaggaagtggggagagcaggctctccctggcaccgagggtgcccaccctctccctggtgtggccccgtcaacatcagccacagcccagccccattagtgggttagtgggtctgacctcagccccactcaggtgctcctgctggcctgcccaagccctgccctcagggagcttctgccttttaagaactgggcagaggccacagtcacctccccacacagagctgtccccactgccctgggtgccaggctgtccggagccaggcctacccagggaggatgcagagagctggtgcccaggatgtgcacccccatattccctctgccctgtggcctcagcccgctggcctctctgaccgtgaggctggctctcagccatcgggcaggtgcctggtcaggcctggcttagcccaggtggggcttggcagaagcgggcgggtgtggaagatattccatctggggccaaccccaggctgggcctgcgctgagcttctggagcgcaggtactgggtcttgctaagtgaactgtttcccaggaacacctctcgggcccatctgcgtctgaggctgggagtggcatctgaggccgggagtggcatctgaggccaggagtggcaggctggtgggctgggcgtggggttttctgggccctgcccagtactgccctggggacttggtgggctcctgggtcagcagcatcccacccctgggagtctggccagctgagccccagggtggcaggggcattatagcctggtggacatgtgccttcagggttcctccggggccaccttcctcaggccagtgctgggttcaaagggctgtgtgtgtgtgtgtttgtgtgtgtatgtatatgtgtgtgggtgcacacatctgtcccatgtatgcagtgagacctgtctacctcccacaaggagcaagggctctgcccgccctctgctcattcctacccaggtagtgggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcagaggtggaaggccctgggccacaggcgagagtgggcgtgtcacctgtcccaggttcccagcaagtctgcagctgtgcagtcctggggtccctgaccctgtcgcccagggggcgtgctgtccagcaggggccctgccttgcaaggaacgtctctccggcggctgggccgctcctgcctggtctgggctgtgtgtggcgccctttcctccttgtttgttcctctgtgttctgtgtgcgtcttaagcaataaagcgtggccgtgggaaaaaaaaaaaaaaaaaaaaaaaaaaaaaaaaaaaaaaaaaaaaaaaaaaaaa

SEQ ID NO: 22 - protein, 172 aa, Homo Sapien
MSSSGGAPGASASSAPPAQEEGMTWWYRWLCRLSGVLGAVSCAISGLFNCITIHPLNIAAGVWMIMNAFILLLCEAPFCCQFIEFANTVAEKVDRLRSWQKAVFYCGMAVVPIVISLTLTTLLGNAIAFATGVLYGLSALGKKGDAISYARIQQQRQQADEEKLAETLEGEL

SEQ ID NO: 23 - DNA, 888 bp, Homo Sapien
gtgaaacacccatggttttatgctctatttctcttttcctcatcttcttccacatcctctttctgaatgtatcaaactacttccttgaagtggggcaccaggagggccactccagtctccaatgcagggactcaggggcagggatctctgagaaagtggccatctcgttattaaagctctgtcctctgcttccctctcacctcagaagcagcccgtttattcaacagagctccaggttgccagctaggggttttcgggaccatagaccaagcaaccccgagagactgagtactgacctgcagttgttccagaaactctgctgggaattaggttgtgacctagaagtgaactgacactaacagtgagaaggcagggtaagaatgcagtctagagcgcaacctttctccactagacttgtaagtaatttaagtgaatcctgtccccctggggttctatcctggctggctctgctggtgaacttgactggccagcatagggcacttgatgagaccctggaatgctgaggccagttgggcagcaagctttcacctcatccttctgcccatctatccagccattcaaacattcattcgcctgaagacatttatcaagctcctgcaatgggtcaggcatctgctaggcactggggacacagagctcacagtctcctggagggggtgagagatgactgacaggtggtctgtggtgcagtgtgacctgggaatgcacacagtactgtggaaacacgggagaggcatctagcacaacctgagagggccaggggaggcttcctggcaggtttccctttaaccatcttaagggaaagaggcactaggtaggaaaataaagggacagtggtgtcccagacagagggcactctacatggaa

SEQ ID NO: 24 - protein, 113 aa, Homo Sapien
MVLCSISLFLIFFHILFLNVSNYFLEVGHQEGHSSLQCRDSGAGISEKVAISLLKLCPLLPSHLRSSPFIQQSSRLPARGFRDHRPSNPERLSTDLQLFQKLCWELGCDLEVN

SEQ ID NO: 25 - DNA, 2534 bp, Homa Sapien
cgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcaaccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcgggcaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcagccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggctcttcagctcccctccctgcttctggaaacctctgcctgctgccctggccctgcccccctgcgcatgcaccatccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggtctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctaatcactgcagtgtccagcccagtgttgaacagattgtagcgttctgtctcattacgagcaaataaatagactttcattgggaaaaaaaaaaaaa

SEQ ID NO: 26 - protein, 242 aa, Homo Sapien [sequence omitted]

SEQ ID NO: 27 - DNA, 991 bp, Homo Sapien
gttgggcagcagccacccgctcacctccatccccaggacttagagggacgcagggcgttgggaacagaggacactccaggcgctgaccctgggaggccaggaccagggccaaagtcccgtgggcaagaggagtcctcagaggtccttcattcagcggttccgggaggtctgggaagcccacggcctggctggggcagggtcaacgccgccaggccgccatggtcctgtgctggctgctgcttctggtgatggctctgcccccaggcacgacgggcgtcaaggactgcgtcttctgtgagctcaccgactccatgcagtgtcctggtacctacatgcactgtggcgatgacgaggactgcttcacaggccacggggtcgccccgggcactggtccggtcatcaacaaaggctgcctgcgagccaccagctgcggccttgaggaacccgtcagctacaggggcgtcacctacagcctcaccaccaactgctgcaccggccgcctgtgtaacagagccccgagcagccagacagtgggggccaccaccagcctggcactggggctgggtatgctgcttcctccacgtttgctgtgaccaacagggaggacagggcctgggactgttctcccagatccgccactccccatgtccccatgtccttcccccactaaatggccagagaggccctggacaacctcttgcggccctggcttcatcccttctaaggctgtccaccaggagcccggtgctaggggaagcatccccaggcctgactgagcggcaggggagcacggcccgtgggtttgattgtattactctgttccactggttctaagacgcagagcttctcacatctcaatcaggatgcttctctccattggtagcactttagagtccatgaaatatggtaaaaaatatatatatatcataataaatgacagctgatgttcatgggggaaaaaaaaaaaaaaaaaaaaaaaaaaaaaaaaaaa

SEQ ID NO: 28 - protein, 124 aa, Homo Sapien
MVLCWLLLLVMALPPGTTGVKDCVFCELTDSMQCPGTYMHCGDDEDCFTGHGVAPGTGPVINKGCLRATSCGLEEPVSYRGVTYSLTTNCCTGRLCNRAPSSQTVGATTSLALGLGMLLPPRLL

SEQ ID NO: 29 - DNA, 2020 bp, Homo Sapien
ggcattttgaaagcccagtgttgcccagggggcatctcctttgtgtttatgagagacctgcattctccctggctcagttctctcaggctctccagagctcaggacctctgagaagaatggagccctcctggcttcaggaactcatggctcaccccttcttgctgctgatcctcctctgcatgtctctgctgctgtttcaggtaatcaggttgtaccagaggaggagatggatgatcagagccctgcacctgtttcctgcaccccctgcccactggttctatggccacaaggagttttacccagtaaaggagtttgaggtgtatcataagctgatggaaaaatacccatgtgctgttcccttgtgggttggaccctttacgatgttcttcagtgtccatgacccagactatgccaagattctcctgaaaagacaagatcccaaaagtgctgttagccacaaaatccttgaatcctgggttggtcgaggacttgtgaccctggatggttctaaatggaaaaagcaccgccagattgtgaaacctggcttcaacatcagcattctgaaaatattcatcaccatgatgtctgagagtgttcggatgatgctgaacaaatgggaggaacacattgcccaaaactcacgtctggagctctttcaacatgtctccctgatgaccctggacagcatcatgaagtgtgccttcagccaccagggcagcatccagttggacagtaccctggactcatacctgaaagcagtgttcaaccttagcaaaatctccaaccagcgcatgaacaattttctacatcacaacgacctggttttcaaattcagctctcaaggccaaatcttttctaaatttaaccaagaacttcatcagttcacagagaaagtaatccaggaccggaaggagtctcttaaggataagctaaaacaagatactactcagaaaaggcgctgggattttctggacatacttttgagtgccaaaagcgaaaacaccaaagatttctctgaagcagatctccaggctgaagtgaaaacgttcatgtttgcaggacatgacaccacatccagtgctatctcctggatcctttactgcttggcaaagtaccctgagcatcagcagagatgccgagatgaaatcagggaactcctaggggatgggtcttctattacctgggaacacctgagccagatgccttacaccacgatgtgcatcaaggaatgcctccgcctctacgcaccggtagtaaacatatcccggttactcgacaaacccatcacctttccagatggacgctccttacctgcaggaataactgtgtttatcaatatttgggctcttcaccacaacccctatttctgggaagaccctcaggtctttaaccccttgagattctccagggaaaattctgaaaaaatacatccctatgccttcataccattctcagctggattaaggaactgcattgggcagcattttgccataattgagtgtaaagtggcagtggcattaactctgctccgcttcaagctggctccagaccactcaaggcctccccagcctgttcgtcaagttgtcctcaagtccaagaatggaatccatgtgtttgcaaaaaaagtttgctaattttaagtcctttcgtataagaattaatgagacaattttcctaccaaaggaagaacaaaaggataaatataatacaaaatatatgtatatggttgtttgacaaattatataacttaggatacttctgactggttttgacatccattaacagtaattttaatttctttgctgtatctggtgaaacccacaaaaacacctgaaaaaactcaagctgacttccactgcgaagggaaattattggtttgtgtaactagtggtagagtggctttcaagcatagtttgatcaaaactccactcagtatctgcattacttttatctctgcaaatatctgcatgatagctttattctcagttatctttccccataataaaaaatatctgccaaa

SEQ ID NO: 30 - protein, 505 aa, Homo Sapien
MEPSWLQELMAHPFLLLILLCMSLLLFQVIRLYQRRRWMIRALHLFPAPPAHWFYGHKEFYPVKEFEVYHKLMEKYPCAVPLWVGPFTMFFSVHDPDYAKILLKRQDPKSAVSHKILESWVGRGLVTLDGSKWKKHRQIVKPGFNISILKIFITMMSESVRMMLNKWEEHIAQNSRLELFQHVSLMTLDSIMKCAFSHQGSIQLDSTLDSYLKAVFNLSKISNQRMNNFLHHNDLVFKFSSQGQIFSKFNQELHQFTEKVIQDRKESLKDKLKQDTTQKRRWDFLDILLSAKSENTKDFSEADLQAEVKTFMFAGHDTTSSAISWILYCLAKYPEHQQRCRDEIRELLGDGSSITWEHLSQMPYTTMCIKECLRLYAPVVNISRLLDKPITFPDGRSLPAGITVFINIWALHHNPYFWEDPQVFNPLRFSRENSEKIHPYAFIPFSAGLRNCIGQHFAIIECKVAVALTLLRFKLAPDHSRPPQPVRQVVLKSKNGIHVFAKKVC

SEQ ID NO: 31 - DNA, 1118 bp, Homo Sapien
tccgctgtcgcccagtcccggccgctggcgggaactgacctggagcaagcaggaccttccctcccacctctcccgcctggcctccgcgggagtcccctacgatcccgctcagcagtggggcactcgctgaggacagcgagtcctgggagtgagcccaaggccacccctggccagcccaggagagatagccagggcaggcccagcagcccgaggccaggctctggccacggcggtctccgacatggagagacattgtctgctttttatcctgttaacctgtcttcggtggttgtgccacgacattccccagggttcaggtgcccggtggccgagggtcagtccagtggtagagccttgctctcctaggctcatcctgctggcggtcctcctgcttctgctgtgtggtgtcacagctggttgtgtccggttctgctgcctccggaagcaggcacaggcccagccacatctgccaccagcacggcagccctgcgacgtggcagtcatccctatggacagtgacagccctgtacacagcactgtgacctcctacagctccgtgcagtacccactgggcatgcggttgcccctgccctttggggagctggacctggactccacggctcctcctgcctacagcctgtacaccccggagcctccaccctcctacgatgaagctgtcaagatggccaagcccagagaggaaggaccagcactctcccagaaacccagccctctccttggggcctcgggcctagagaccactccagtgccccaggagtcgggccccaatactcaactaccaccttgtagccctggtgccccttgaaggaggtaggagaacggaccagagcttggagaactaatgcttggagccaagggccccagcccaccccaccgtcccacacattgctgtggccccaacctcggtgccatgttacaccggcccctggcgtcacccactaggcaggctgctgctttcagcctcagcccctggcccagccccagcaggccctcagcctggaagaggccccttgggcctaagcctcgggtgggagctcagggccacctgtgacgtctgcatcttcttggagagagaataaagtttgtatttaagtggt

SEQ ID NO: 32 - protein, 194 aa, Homo Sapien [sequence omitted]

SEQ ID NO: 33 - DNA, 1976 bp, Homo Sapien
ccttgcttggtgcttggcacacacaaatccagtgggctacacaggttttccagaagccccacgaggtggtaatggtgctgctgattcagaccctgggggccctcatgccctcgctgccctcctgcctcagcaacggcgtggagagggcagggcccgagcaggagctcaccaggctgctggagttctacgacgccaccgcccacttcgccaagggcttggagatggcactgctcccccacctacatgaacacaatctggtaaaagtcacggagctggtggatgctgtgtatgatccatacaaaccctaccagctgaagtatggcgacatggaagagagcaacctcctcatccagatgagtgctgtgcctctggagcatggggaagtgattgactgtgtgcaggagctgagccactccgtgaacaagctgtttggtctggcgtctgcagccgttgacagatgcgtcagattcaccaatggcctggggacctgcggcctgttgtcagccctgaaatccctctttgccaagtatgtgtctgatttcaccagcactctccagtccatacgaaagaagtgcaaactggaccacattcctcccaactccctcttccaggaagattggacggcttttcagaactccattaggataatagccacctgtggagagcttttgcggcattgtggggacttcgagcagcagctagccaacaggattttgtccacagctgggaagtatctatctgattcctgcagcccccggagcctggctggttttcaggagagcatcttgacagacaagaagaactctgccaagaacccatggcaagaatataattacctccagaaagataaccctgctgaatatgccagtttaatggaaatactttatacccttaaggaaaaagggtcaagcaaccacaacctgctggctgcacctcgagcagcgctgactcggcttaaccagcaggcccaccagctggctttcgattccgtgttcctgcgcatcaaacaacagctgttgcttatttcgaagatggacagctggaatacggctggcatcggagaaaccctcacagatgaactgcccgcctttagtctcacccctctcgagtacatcagcaacatcgggcagtacatcatgtccctccccctgaatcttgagccatttgtgactcaggaggactctgccttagagttggcattgcacgctggaaagctgccatttcctcctgagcagggggatgaattgcccgagctggacaacatggctgacaactggctgggctcgatcgccagagccacaatgcagacctactgtgatgcgatcctacagatccctgagctgagcccacactctgccaagcagctggccactgacatcgactatctgatcaacgtgatggatgccctgggcctgcagccgtcccgcaccctccagcacatcgtgacgctactgaagaccaggcctgaggactatagacaggtcagcaaaggcctgccccgtcgcctggccaccaccgtggccaccatgcggagtgtgaattactgaccccaccacacaccggaccaccaagagagccagggctgctgtttcgtgactcaccagcacagatttgctcagaaactctgcccaagattgggcagaagttactttaaaaagacttggttcagctggtcacggtggctcacgcctgtaatcccagcactttgggaggccaagccagatggatcatgaggccaggagttcgagaccagcctgaccaacatggtgaaaccccatctctactaaaaatacaaaaattaacagcagagcgagactctgtctcaaaaaaaaaaaaaaaaagacttggttcatttgtataatcaaaaagagttgtaaattaaagatgtattatttatcagagaagactttttagataatttttttaaaggatcagatcttgaaaatggaataaataactactgtgaaatgcaaaaa

SEQ ID NO: 34 - protein, 491 aa, Homo Sapine
MVLLIQTLGALMPSLPSCLSNGVERAGPEQELTRLLEFYDATAHFAKGLEMALLPHLHEHNLVKVTELVDAVYDPYKPYQLKYGDMEESNLLIQMSAVPLEHGEVIDCVQELSHSVNKLFGLASAAVDRCVRFTNGLGTCGLLSALKSLFAKYVSDFTSTLQSIRKKCKLDHIPPNSLFQEDWTAFQNSIRIIATCGELLRHCGDFEQQLANRILSTAGKYLSDSCSPRSLAGFQESILTDKKNSAKNPWQEYNYLQKDNPAEYASLMEILYTLKEKGSSNHNLLAAPRAALTRLNQQAHQLAFDSVFLRIKQQLLLISKMDSWNTAGIGETLTDELPAFSLTPLEYISNIGQYIMSLPLNLEPFVTQEDSALELALHAGKLPFPPEQGDELPELDNMADNWLGSIARATMQTYCDAILQIPELSPHSAKQLATDIDYLINVMDALGLQPSRTLQHIVTLLKTRPEDYRQVSKGLPRRLATTVATMRSVNY

SEQ ID NO: 35 - DNA, 1227 bp, Homo Sapien
gcaagtgccaccatgctagtgtgatttggacttcagtaaaagttagtttgcttccttcccgttgtcccatctcactcctgggccacccatggggctgctggtagctggtgtgtggctgctgctggactgtgtggcagtccatccatctgtcagcagccactgcgggcctacttgctgggtgcccagcaccgcactcaccactgcaggcgtggccaggagcgtgagatccccagagcccatggccagtgagaggcggccagggataggtacccagggaatgccacaggagtttgctgggctcacggagctctttcactggtcagagaggagtgtgtgtaggagaggacttctacttggtgttgaaggacagatggggtttggctgggagagaggaggaatgtgggcgggccttataggcaggcgagaaggtgagagccaaggccctctgtgggcagggcgaggtggcgtgttgaggagactcgtccagctgggcagaggctcatgttgagggatgaggcagagctgggggaggagggagcccagaaatggcaggtccttgaatgcaggtttggaagcagggacgccctgtgagggtacagagtctgggctgttaccttctgtggcttttgctagaaggtgagatgtcagggaggaagacaggactccaggatgtctcctgtctctctctggaaaaaggaggtgggcccctttctcagcagtcagctgctgtttttgaggtcttctccatggataatccacggtgttggaagtggttaaggtaatggatcctcatgggcttaccataaaaatatctggaggctggaccattttccttaaaacgttataaaagctggaattgaatgccatcggtgtcacccctgggaagtgtgctttctcttgagctcttttggccccgagatagcagtcactccatagtttcgtgaagaccagcctggtgttgcctggttttctgccattagggagcagctagaggtcttccagtagctcctgtgtaaagtgatgaaagaaaagggctgggtgctgactgctcctggagaaaagcaacacactcccaaagtcttaattgcctgcttccagggagctgtggtggtttcccttgggcagggcacacgccccagtggttgacttaataaggatacattttaatcagaggacaaaaatgtgccctgacttgatttccgcatgggcttccagcatggtcaaagg

SEQ ID NO: 36 - protein, 139 aa, Homo Sapien
MGLLVAGVWLLLDCVAVHPSVSSHCGPTCWVPSTALTTAGVARSVRSPEPMASERRPGIGTQGMPQEFAGLTELFHWSERSVCRRGLLLGVEGQMGFGWERGGMWAGLIGRREGESQGPLWAGRGGVLRRLVQLGRGSC

SEQ ID NO: 37 - DNA, 1225 bp, Homo Sapien
ggccaggaatggggtccccgggcatggtgctgggcctcctggtgcagatctgggccctgcaagaagcctcaagcctgagcgtgcagcaggggcccaacttgctgcaggtgaggcagggcagtcaggcgaccctggtctgccaggtggaccaggccacagcctgggaacggctccgtgttaagtggacaaaggatggggccatcctgtgtcaaccgtacatcaccaacggcagcctcagcctgggggtctgcgggccccagggacggctctcctggcaggcacccagccatctcaccctgcagctggaccctgtgagcctcaaccacagcggggcgtacgtgtgctgggcggccgtagagattcctgagttggaggaggctgagggcaacataacaaggctctttgtggacccagatgaccccacacagaacagaaaccggatcgcaagcttcccaggattcctcttcgtgctgctgggggtgggaagcatgggtgtggctgcgatcgtgtggggtgcctggttctggggccgccgcagctgccagcaaagggactcaggaaatgcattctacagcaacgtcctataccggccccggggggccccaaagaagagtgaggactgctctggagaggggaaggaccagaggggccagagcatttattcaacctccttcccgcaaccggccccccgccagccgcacctggcgtcaagaccctgccccagcccgagaccctgccccagccccaggcccggccaccccgtctctatggtcagggtctctcctagaccaagccccacccagcagccgaggccaaaagggttccccaaagtgggagaggagtgagagatcccaggagacctcaacaggaccccacccataggtacacacaaaaaaggggggatcgaggccagacacggtggctcacgcctgtaatcccagcagtttgggaagccgaggcgggtggaacacttgaggtcaggggtttgagaccagcctggcttgaacctgggaggcggaggttgcagtgagccgagattgcgccactgcactccagcctgggcgacagagtgagactccgtctcaaaaaaaaaacaaaaagcaggaggattgggagcctgtcagccccatcctgagaccccgtcctcatttctgtaatgatggatctcgctcccactttcccccaagaacctaataaaggcttgtgaagaaaaaaaaaaaaaaaa

SEQ ID NO: 38 - protein, 278 aa, Homo Sapien
MGSPGMVLGLLVQIWALQEASSLSVQQGPNLLQVRQGSQATLVCQVDQATAWERLRVKWTKDGAILCQPYITNGSLSLGVCGPQGRLSWQAPSHLTLQLDPVSLNHSGAYVCWAAVEIPELEEAEGNITRLFVDPDDPTQNRNRIASFPGFLFVLLGVGSMGVAAIVWGAWFWGRRSCQQRDSGNAFYSNVLYRPRGAPKKSEDCSGEGKDQRGQSIYSTSFPQPAPRQPHLASRPCPSPRPCPSPRPGHPVSMVRVSPRPSPTQQPRPKGFPKVGEE

SEQ ID NO: 39 - DNA, 1837 bp, Homo Sapien
accagcagaaggctgggagtctgtagtttgttcctgctgccaggctccactgaggggaacggggacctgtctgaagagaagatgcccctgctgacactctacctgctcctcttctggctctcaggctactccattgccactcaaatcaccggtccaacaacagtgaatggcttggagcggggctccttgaccgtgcagtgtgtttacagatcaggctgggagacctacttgaagtggtggtgtcgaggagctatttggcgtgactgcaagatccttgttaaaaccagtgggtcagagcaggaggtgaagagggaccgggtgtccatcaaggacaatcagaaaaaccgcacgttcactgtgaccatggaggatctcatgaaaactgatgctgacacttactggtgtggaattgagaaaactggaaatgaccttggggtcacagttcaagtgaccattgacccagcaccagtcacccaagaagaaactagcagctccccaactctgaccggccaccacttggacaacaggcacaagctcctgaagctcagtgtcctcctgcccctcatcttcaccatattgctgctgcttttggtggccgcctcactcttggcttggaggatgatgaagtaccagcagaaagcagccgggatgtccccagagcaggtactgcagcccctggagggcgacctctgctatgcagacctgaccctgcagctggccggaacctccccgcgaaaggctaccacgaagctttcctctgcccaggttgaccaggtggaagtggaatatgtcaccatggcttccttgccgaaggaggacatttcctatgcatctctgaccttgggtgctgaggatcaggaaccgacctactgcaacatgggccacctcagtagccacctccccggcaggggccctgaggagcccacggaatacagcaccatcagcaggccttagcctgcactccaggctccttcttggaccccaggctgtgagcacactcctgcctcatcgaccgtctgccccctgctcccctcatcaggaccaacccggggactggtgcctctgcctgatcagccagcattgcccctagctctgggttgggcttggggccaagtctcagggggcttctaggagttggggttttctaaacgtcccctcctctcctacatagttgaggagggggctagggatatgctctggggctttcatgggaatgatgaagatgataatgagaaaaatgttatcattattatcatgaagtaccattatcataatacaatgaacctttatttattgcctaccacatgttatgggctgaataatggcccccaaagatatctgtgtcctaatcctcagaacttgtgactgttaccttctgtggcagaaagggacagtgcagatgtatgtaagttaaggactttgagatagagaggttattcttgctgattcaggtgggcccaaaatatcaccacaagggtcctcataagaaagaggccagaaggtcaaagaggtagagacaaagtgatgatggaagtggacgtgggtgtgacgtgagcaggggccatgaatgccgcagccttcagatgccagaaagggaaaggaatggattcccctgcctggagcctccaaaagaaaccagccctgcccacgccttgacttgagcccattgaaactgatcttgagctcctggcctccagaattgcaggagaataaatttgtgttgtttttaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaag

SEQ ID NO: 40 - protein, 290 aa, Homo Sapien [sequence omitted]

SEQ ID NO: 41 - DNA, 2683 bp, Homo Sapien
aagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaactactctaaaatcttatgattcaaacaccccaggacctactggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagaca

SEQ ID NO: 42 - protein, 572 aa, Homo Sapien [sequence omitted]

SEQ ID NO: 43 - DNA, 1434 bp, Homo Sapien
gcatagatgaatgtatcagtggatggatagttggctagatgggtgggttggtggatgaatggcagagcttgcacctgccagtccatctgacatcaaagccagtgtctctaatggtgacaccaccctcctctgcagcaggaggcagagctgtgggatgaatgaggttcgccaggtctcccttacctatcctgggtccccagctccttctcactctcttcccttgcagcctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtagccatctttgtgttcatgatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggcatggcaaaaaaaaaaaaaaaaaaaaaaaaaaaaaaaaaaaaaaaaaaaaaaaaaaaaaaaaaaaaaaaaaaaaaaaaaaaaaaaaaga

SEQ ID NO: 44 - protein, 283 aa, Homo Sapien
MADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMIRTLRLKILADAAAEGVPVRGARNQLRMYLTMAVAAAQPMLMYWLTFHLVR

SEQ ID NO: 45 - DNA, 1205 bp, Homo Sapien
gctgagcaccaacaggaactattccagtgaagagcaagtgctgcccgacccaggaccctgtgccaggctggcagccctccagctccctccagagaggaaacctctgtctggctgagggtgggactagctgggatgtctcactccagttgctcaggttcacccaggaagctcctccgtggagtggccagcctgattctagccctgtcctctctggcagcacatgccacacctgcctgggccttctgctccctgatgcttgatgagcccctgcctcctcaatgtttctcaaagacagacccccctgaggccagcttgaatgtgaagactgctgaagtcagctggcttcacttgagctgcagaaaaggtggctgggatggcccaggtgcacccagaggccccagccctttggctgcctttgggttgtgacttgggttgtctctgaggccctgccagagctgggcctgcgggtggtgggcggtccgacctcgggcagtcagtgctccgcagcctcagcactgcatcccagacccagtgtcctcagagggaagagccagcctccctgcctcatggaaccaggagtcccaaaaagtcaggagcctggaggctctgaaaggagcagggattccatagtgcgtgaagctgaaataggcgccctcctggggagcccccagcaaaactgtttttcatacccactcccagaactgccccgctccagctccagcgccagcgccagctggttgccaggcgtcattggagaggcctggctgccccaggggcagcagggagtggtggacctgtatgggctggcaggaggccattggccatgctgacaagtgtcacctgccttcctagcctggagccacccctcaggtggcctgcttgcacctcctatccggaggtagcctgccccacctgtaggcagagggggctcttgcttgaggcctgcacaggaagcaagtatagccccggtgccccagagtgggttccacttagccctggcgagatggcctgtcctgagatctctgctcccagaccccaccatctggggagcacagtccttaggctgcctggtccaggaagggggtgcggctctgtcaggaaacctggactctcaaggcccaccagcctctccgtgagtgttagaaatcacagatacagtatatacttaattacactactcactactcaaaaaaaaaaaaaaaaaa

SEQ ID NO: 46 - protein, 97 aa, Homo Sapien
MSHSSCSGSPRKLLRGVASLILALSSLAAHATPAWAFCSLMLDEPLPPQCFSKTDPPEASLNVKTAEVSWLHLSCRKGGWDGPGAPRGPSPLAAFGL

SEQ ID NO: 47 - DNA, 983 bp, Homo Sapien
ttccgggccctggcgtctcgtctccttaccctggggctacccttgcccggtcctactgcccgcggttaacccgccgcgagccgcctctcccctccccgcccgactcaaccctgccctcccccgtgctttgcagacgccgcccgggggcccaggcggctgatgcgtgtgggcctcgcgctgatcttggtgggccacgtgaacctgctgctgggggccgtgctgcatggcaccgtcctgcggcacgtggccaatccccgcggcgctgtcacgccggagtacaccgtagccaatgtcatctctgtcggctcggggctgctgagcgtttccgtgggacttgtggccctcctggcgtccaggaaccttcttcgccctccactgcactgggtcctgctggcactagctctggtgaacctgctcttgtccgttgcctgctccctgggcctccttcttgctgtgtcactcactgtggccaacggtggccgccgccttattgctgactgccacccaggactgctggatcctctggtaccactggatgaggggccgggacatactgactgcccctttgaccccacaagaatctatgatacagccttggctctctggatcccttctttgctcatgtctgcaggggaggctgctctatctggttactgctgtgtggctgcactcactctacgtggagttgggccctgcaggaaggacggacttcaggggcagctagaggaaatgacagagcttgaatctcctaaatgtaaaaggcaggaaaatgagcagctactggatcaaaatcaagaaatccgggcatcacagagaagttgggtttaggacaggtgctgttccgagactcagtcctaaagggttttttttcccactaagcaaggggccctgacctcgggatgagataacaaattgtaataaagtaacttctcttttcttctaaaaaaaaaaaaaaaaaaaaaaaaaaaaaaaaaaaaaaaaaa

SEQ ID NO: 48 - protein, 222 aa, Homo Sapien
MRVGLALILVGHVNLLLGAVLHGTVLRHVANPRGAVTPEYTVANVISVGSGLLSVSVGLVALLASRNLLRPPLHWVLLALALVNLLLSVACSLGLLLAVSLTVANGGRRLIADCHPGLLDPLVPLDEGPGHTDCPFDPTRIYDTALALWIPSLLMSAGEAALSGYCCVAALTLRGVGPCRKDGLQGQLEEMTELESPKCKRQENEQLLDQNQEIRASQRSWV

SEQ ID NO: 49 - DNA, 847 bp, Homo Sapien
cgtcagtctagaaggataagagaaagaaagttaagcaactacaggaaatggctttgggagttccaatatcagtctatcttttattcaacgcaatgacagcactgaccgaagaggcagccgtgactgtaacacctccaatcacagcccagcaagctgacaacatagaaggacccatagccttgaagttctcacacctttgcctggaagatcataacagttactgcatcaacggtgcttgtgcattccaccatgagctagagaaagccatctgcaggtgttttactggttatactggagaaaggtgtgagcacttgactttaacttcatatgctgtggattcttatgaaaaatacattgcaattgggattggtgttggattactattaagtggttttcttgttattttttactgctatataagaaagaggtatgaaaaagacaaaatatgaagtcacttcatatgcaatcgtttgacaaatagttattcaggccctataatgtgtcaggcactgacatgtaaaatttttttaattaaaaaagagctgtaatctggcaaaaagtttctatgtaatatttttcatgccttttctcataaacccagacgagtggtaaaaatttgccttcagttgtaataggagagttcaaacgtacagtctcccttcaacctatctctgtctgcccatatcaaaattataaatgaggaggacagcaggccccaagaaagtagggactaagtatgtcttgttcaaaattgtatattcagtgacttacactatgcctagcacacaacacacactgagtaaatatttgttgagtgaaataaaatcaagaaacaagtaaaaactga

SEQ ID NO: 50 - protein, 133 aa, Homo Sapien
MALGVPISVYLLFNAMTALTEEAAVTVTPPITAQQADNIEGPIALKFSHLCLEDHNSYCINGACAFHHELEKAICRCFTGYTGERCEHLTLTSYAVDSYEKYIAIGIGVGLLLSGFLVIFYCYIRKRYEKDKI

SEQ ID NO: 51 - DNA, 978 bp, Homo Sapien
ggctcgagcttggctctcagaccatcctggtggaagaaacactagcagtctgcccaatctgaatgcaaatccagaataatcttttcttttgttgttacacagttatgagtgcaatttttaaatggctgctactctacagcctgcctgccttatgctttctcctgggcacgcaggaaagtgagagcttccactccaaagcagagatcctagtgacactaagtcaggtaataatctctccagctggacctcatgcactcacatggacaacacacttctctccttcagtgatcatcatccttgtaccatgttggtggcatgctgtaatcgtgactcaacatccggttgccaattgctatgtaacaaaccacctcaacattcagtggcttgaattgaaagcagggtcttgaagagatatttgcacatttcatcctcccagcagcattattcacaacagccaataggcagaagcaacccaatgtccaaccatagatgagtggataaccaaaatgtagtccatccatacaatgaaatatgattcagccttaacaaggaaggaagtcccgccacgtgctacaacatggatggaccttgaggacactatgctaagtgaagtaagccaggcacaaaaggacaaatactctatgattccattttatagggtaccaaagagaatcaaactcacagagatagaaagtagactggggtggccagggactcggggagagaggaaagggcagttattgtttaaaaggtacagagtttcagtttgggaagatgaaaatgttctggaaacggttaatggtgattttacattgtttatgttaccacgatttgtaaaagagcagctgcgctgagaatgagcatgcttgtcattggcagctctctgagattttcagtgcctcttactggcttgttaagaagacggcaaaaaaaaaaaaaaaaaaaaaaaaaaaaaaaaaaaaaaaaaaaaaaaaaaaa

SEQ ID NO: 52 - protein, 114 aa, Homo Sapien
MQIQNNLFFCCYTVMSAIFKWLLLYSLPALCFLLGTQESESFHSKAEILVTLSQVIISPAGPHALTWTTHFSPSVIIILVPCWWHAVIVTQHPVANCYVTNHLNIQWLELKAGS

SEQ ID NO: 53 - DNA, 1664 bp, Homo Sapien
ttttgaaatggtttatgacctcttccccacttccccgcttgctttgctcattagtgttcctaggtggctgctgggtgacgggcttttcatcatctctgatgtgggccagtgcgaaagagcagctgcaacatctgtttctaattgggtcgtgcctttataaatacttcttgcctatttgtcacattgcttccctcccaccctgtcttccttggagtactgcagaatctgtaagcgtccctggaatgcacacgtggaccttgtcattcccaaacagactttctgctggtcagcactttgtaatgttcggctgttacaggcattagtcacttgtgctcagagagagactgtggtctttggaaactgaagaaaatgtcttttttgttgttgttaattcttggcatccagttagatttaacttctcaagagtttacacagacttttagaaaaacattctgtctctaagaaaaaagtgctctagctttgtacagtttttggattttcacacttggtggttgtttgctgaaatgctgttttgctagtgattcccctcctccccctatctggggttgtaagcagctctggggctctgttcacttcggatacctgtttctggggactgcttttcaacagcgtttttcctaagggcatatgagaaatttaatttctgatggaatgaaggtgaaactctagtcccaggtaaacctgggtaggctgtagagacagaaagggggctgcaggtctaggtggaagaacgagaacgaatgcagcatggtatttccaggccttttagattcggcttcatccacaaccaatgtgagttcttatctgcaaagcgggcctaagtgtaatggagggaaggtgggccaggcaccagggtcctgggttctcccgcgcctcactctgtctccacctggcccatgcataaagaacactagtcaagtagccattgtacctgtttccttatctgaaaatgagaaggttggagagtatgacttctgttgaaacaacaaggcgcttacaaattttggtgaagtcgaatgagggcagcgttaagagaaatatcaaagttagtcattggatttcagggcttagggatggaaaccagctggtagtagactggttgtagttatgtccaaagggcagagtgggaaaaatttggccgaaaagagtgtggtgggtgaccagcaaatgttagaggtatacatcagggcacagaggagaaaagctaacatgatactgatgacttcaagtcttcactgtccaattcagaggataggggagggtttaagctgattaaacagtgggctttttttctcctgcaagagggtggaggtctataactgtgcagattttatcagatgcatgctaatacatgttattctgggggactctcttataccttgaagtagacattgctgctatttgcgtgaaaaaaataggaggacttatttgaattgagaatggggataggctgagttccaccgagatgttggcttagagatgcctgggccatgctgtacagtaggaagcccagcagaggagattgggctgtgtgggtcatgacaaagggagttgttagcttatggttggctattaaagtcatgggcaaggatgggcaagaaaagtgtgtaaaatgagctgacaaaagataaatatgttaatta

SEQ ID NO: 54 - protein, 102 aa, Homo Sapien
MTSSPLPRLLCSLVFLGGCWVTGFSSSLMWASAKEQLQHLFLIGSCLYKYFLPICHIASLPPCLPWSTAESVSVPGMHTWTLSFPNRLSAGQHFVMFGCYRH

SEQ ID NO: 55 - DNA, 1824 bp, Homo Sapien
acactggccaaacactcgcatcccagggcgtctccggctgctcccattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatgacctgggatgacgaactggagaagtctgctgcagcgtgggccagtcagtgcatctgggagcacgggcccaccagtctgctggtgtccatcgggcagaacctgggcgctcactggggcaggtatcgctctccggggttccatgtgcagtcctggtatgacgaggtgaaggactacacctacccctacccgagcgagtgcaacccctggtgtccagagaggtgctcggggcctatgtgcacgcactacacacagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagaagaaacctacactccaaaacctgaaacggacgagatgaatgaggtggaaacggctcccattcctgaagaaaaccatgtttggctccaaccgagggtgatgagacccaccaagcccaagaaaacctctgcggtcaactacatgacccaagtcgtcagatgtgacaccaagatgaaggacaggtgcaaagggtccacgtgtaacaggtaccagtgcccagcaggctgcctgaaccacaaggcgaagatctttggaagtctgttctatgaaagctcgtctagcatatgccgcgccgccatccactacgggatcctggatgacaagggaggcctggtggatatcaccaggaacgggaaggtccccttcttcgtgaagtctgagagacacggcgtgcagtccctcagcaaatacaaaccttccagctcattcatggtgtcaaaagtgaaagtgcaggatttggactgctacacgaccgttgctcagctgtgcccgtttgaaaagccagcaactcactgcccaagaatccattgtccggcacactgcaaagacgaaccttcctactgggctccggtgtttggaaccaacatctatgcagatacctcaagcatctgcaagacagctgtgcacgcgggagtcatcagcaacgagagtgggggtgacgtggacgtgatgcccgtggataaaaagaagacctacgtgggctcgctcaggaatggagttcagtctgaaagcctggggactcctcgggatggaaaggccttccggatctttgctgtcaggcagtgaatttccagcaccaggggagaaggggcgtcttcaggagggcttcggggttttgcttttatttttattttgtcattgcggggtatatggagagtca

SEQ ID NO: 56 - protein, 497 aa, Homo Sapien [sequence omitted]

SEQ ID NO: 57 - DNA, 486 bp, Homo Sapien
gcacgaggccaaacacagcagcctcaacatgaaggtggttatggtcctcctgcttgctgccctccccctttactgctatgcaggttctggttgcgttcttctggagagcgtcgtggaaaagaccatcgatccatcggtttctgtggaggaatacaaagcagatcttcagaggttcatcgacactgagcaaaccgaagcagctgtagaggagttcaaggagtgcttcctcagccagagcaatgagactctggccaacttccgagtcatggtgcatacgatatatgacagcctttactgtgctgcgtattaactgtcacaagaactttggctcagaggaatccagacgatgctcacaacccgactgtggactggcagaaatctcaacttttccttttgactttcccctttgatcagtaatatggaagacgttgttgaaacctgaagtatagttaatttaaataaacccactgcaagaaaaaaaaaaaa

SEQ ID NO: 58 - protein, 93 aa, Homo Sapien [sequence omitted]

SEQ ID NO: 59 - DNA, 3976 bp, Homo Sapien
caagtccgttgaggctgccaggcgagtcaggtctctctggacctcgcctgactcggctgggctgtgcctgaaattgacccagctccaccatactccttgattatgagaaaacaaggagtaagctcaaagcggctgcaatcttccggccgcagccagtctaaggggcggcgcggggcctccctcgcccgggagccggaggtagaggaggaggtggaaaagtcggtcctaggcggcgggaaactgccaaggggcgcctggaggtcctccccggggaggatccaaagtctgaaagagcgaaaaggcttggagctagaggtggtggccaagacctttcttctcggccccttccagttcgtccgtaattccctggcgcagctccgggaaaaggtgcaggaactgcaggcgcggcggttctccagcagaaccactctcggcatcgctgtctttgtggcaattttacattggttacatttagtaacactttttgaaaatgatcgtcatttctctcacctctcatctttggaacgggagatgacttttcgcactgaaatgggactttattattcatacttcaagaccattattgaagcaccttcgtttttggaaggactgtggatgattatgaatgacaggcttactgaatatcctcttataattaatgcaataaaacgcttccatctttatccagaggtaatcatagcctcctggtattgcacattcatgggaataatgaatttatttggactagaaactaagacctgctggaatgtcaccagaatagaacctcttaatgaagttcaaagctgtgaaggattgggagatcctgcttgcttttatgttggtgtaatctttattttaaatggactaatgatgggattgttcttcatgtatggagcatacctgagtgggactcaactgggaggtcttattacagtactgtgcttctttttcaaccatggagaggccacccgtgtgatgtggacaccacctctccgtgaaagtttttcctatcctttccttgtacttcagatgtgtattttaactttgattctcaggacctcaagcaatgatagaaggcccttcattgcactctgtctttccaatgttgcttttatgcttccctggcaatttgctcagtttatactttttacacagatagcatcattatttcccatgtatgttgtgggatacattgaaccaagcaaatttcagaagatcatttatatgaacatgatttcagttacccttagtttcattttgatgtttggaaattcaatgtacttatcttcttattattcttcatctttgttaatgacgtgggcaataattctaaagagaaatgaaattcaaaaactgggagtatctaaactcaacttttggctaattcaaggtagtgcctggtggtgtggaacaatcattttgaaatttctgacatctaaaatcttaggcgtttcagaccacattcgcctgagtgatcttatagcagccagaatcttaaggtatacagattttgatactttaatatatacctgtgctcccgaatttgacttcatggaaaaagcgactccgctgagatacacaaagacattattgcttccagttgttatggtgattacatgttttatctttaaaaagactgttcgtgatatttcatatgttttagctacaaacatttatctaagaaaacagctccttgaacacagtgagctggcttttcacacattgcagttgttagtgtttactgcccttgccattttaattatgaggctaaagatgtttttgacaccgcacatgtgtgttatggcttccttgatatgctctcgacagctctttggctggctttttcgcagagttcgttttgagaaggttatctttggcattttaacagtgatgtcaatacaaggttatgcaaacctccgtaatcaatggagcataataggagaatttaataatttgcctcaggaagaacttttacagtggatcaaatacagtaccacatcagatgctgtctttgcaggtgccatgcctacaatggcaagcatcaagctgtctacacttcatcccattgtgaatcatccacattacgaagatgcagacttgagggctcggacaaaaatagtttattctacatatagtcgaaaatctgccaaagaagtaagagataaattgttggagttacatgtgaattattatgttttagaagaggcatggtgtgttgtgagaactaagcctggttgcagtatgcttgaaatctgggatgtggaagacccttccaatgcagctaaccctcccttatgtagcgtcctgctcgaagacgccaggccttacttcaccacagtatttcagaatagtgtgtacagagtattaaaggttaactgagaaggatactacccattttactatggcacaatgccgtgtgtcaaaaacaatcaccctttggcttattcacattaataaaaatcacaagctttaataacagacacttaaaaataagataaaaatggattggaaatttttctgattactaaaaggtaaattacttttctgttcattgaatgtcagccttattaagcttgtcatataagttattaaatcattcatgtcatactgcataaacaaatgttcatttcagaattttaaagagaaatgtatataaagaacmatgattttaataatcaggggtatgtaagtcctttttcatccaactaggtgaattgcttcagattttctctagtaccagagggtacctcctcaaactctttgaaccacttaaggcagaagaatgcaagctctgaaatgacatccttaaaatgctgatactggtcacagcctctttacctctgtgaggaaattgtaacagtgtgtcttttaaggtgtttttattttaccagcccttaagaaagatctctaataccttttaatacttttttttaataatttcaagttgaagtgtttttaaaaacactttgttttgtaatgttttgaatctcttgagatgtgtttaccccactagatacatatttgccactggttagttctccatctaagctcaagaggttattcatctctctttagattccagtggcttttcttttaacatccaggtaaaacagaaactgctatggtatacaaccaagttttggggttaaacataatcagaaaagaaaatccagttaaatttatgaagtgagattttcagatcctagatcttgaataaaggaaaggtcttttcatcttgatggccccaaagcttgttggtcatggtctttatttctggccactatcttcttaaataatatatttttaagccctcatttatttttggttttgggtgaggaaagtcatgttttctaagtcctctcccctaataaaacctacccaacaatagtgctttgaaaagtggtagttatcttgaagatactcttgccaaatgcaaagataaacattctttttgtctgctttataaatatgaaatatgccagatctatagtattttaatgtgcatctactttaaatgagtcatcttggggtttttataattcccttatgttcttgcccctctacacttgaaataacaaaatgccttaattttatggattagttctcttatagtagacaggcagctatatgcagcaaaaccaataaagttatttttcaactttcatagttgtaaaatatcttataccagaatacaaaacagctaagaaaacatgccacattttattttagcattttcaaataatttgtttttggtgtaagcacaggataaaaaaggagagcgtcaaagaaaagagacataacacctaacattcataaaaattaacaaagtatattttggatgatgtttttacaggaaatattttaaataagttggtagaacttttaaaatggtactgtattagctaataaaatattcagtacaaatatatgtttggatttatgcattaaaaaactaataaaattatttccaacttta

SEQ ID NO: 60 - protein, 758 aa, Homo Sapien
MRKQGVSSKRLQSSGRSQSKGRRGASLAREPEVEEEVEKSVLGGGKLPRGAWRSSPGRIQSLKERKGLELEVVAKTFLLGPFQFVRNSLAQLREKVQELQARRFSSRTTLGIAVFVAILHWLHLVTLFENDRHFSHLSSLEREMTFRTEMGLYYSYFKTIIEAPSFLEGLWMIMNDRLTEYPLIINAIKRFHLYPEVIIASWYCTFMGIMNLFGLETKTCWNVTRIEPLNEVQSCEGLGDPACFYVGVIFILNGLMMGLFFMYGAYLSGTQLGGLITVLCFFFNHGEATRVMWTPPLRESFSYPFLVLQMCILTLILRTSSNDRRPFIALCLSNVAFMLPWQFAQFILFTQIASLFPMYVVGYIEPSKFQKIIYMNMISVTLSFILMFGNSMYLSSYYSSSLLMTWAIILKRNEIQKLGVSKLNFWLIQGSAWWCGTIILKFLTSKILGVSDHIRLSDLIAARILRYTDFDTLIYTCAPEFDFMEKATPLRYTKTLLLPVVMVITCFIFKKTVRDISYVLATNIYLRKQLLEHSELAFHTLQLLVFTALAILIMRLKMFLTPHMCVMASLICSRQLFGWLFRRVRFEKVIFGILTVMSIQGYANLRNQWSIIGEFNNLPQEELLQWIKYSTTSDAVFAGAMPTMASIKLSTLHPIVNHPHYEDADLRARTKIVYSTYSRKSAKEVRDKLLELHVNYYVLEEAWCVVRTKPGCSMLEIWDVEDPSNAANPPLCSVLLEDARPYFTTVFQNSVYRVLKVN

SEQ ID NO: 61 - DNA, 2449 bp, Homo Sapien
ggcgcggccacatcctttaaatatggtctttcttgggcgcgcgcgacaatgtgaggagtggggtggagcgtgtgtggtgtgtggctgcggcctgggcaagagccgccgcggaccatgagctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagacgtataggagaaaatttgaatgcctcagcaagttctgtagaaaatgagccggcagttagttcagcaactcaagcaaaggaaaaagttaaaaccacaattggaatggttcttcttccaaaaccaagagttccttatcctcgtttctctcgtttctcacagagagagcagaggagttatgtggacttgttggttaaatacgcaaagattcctgcaaattccaaagctgttggaataaataaaaatgactacttgcagtacttggatatgaaaaaacatgtgaacgaagaagttactgagttcctaaagtttttgcagaattctgcaaagaaatgtgcgcaggattataatatgctttctgatgatgcccgtctcttcacagagaaaattttaagagcttgcattgaacaagtgaaaaagtattcagaattctatactctccacgaggtcaccagcttaatgggattcttcccattcagagtagagatgggattaaagttagaaaaaactcttctcgcattgggcagtgtaaaatatgtgaaaacagtatttccctcaatgcctataaagttgcagctgtcaaaggacgatatagctaccattgaaacgtcagaacaaacagctgaagctatgcattatgatattagtaaagatccaaatgcagagaagcttgtttccagatatcaccctcagatagctctaactagtcagtcattatttaccttattaaataatcatggaccaacgtacaaggaacagtgggaaattccagtgtgtattcaagtaatacctgttgcaggttcaaaaccagttaaagtaatatatattaattcaccacttccccaaaagaaaatgactatgagagagagaaatcaaatctttcatgaagttccattaaaatttatgatgtccaaaaacacatctgttccagtctctgcagtctttatggacaaacctgaagagtttatatctgaaatggacatgtcctgtgaagtcaacgagtgccgaaaaattgagagtcttgaaaacttgtatttggattttgatgatgatgtcacagaacttgaaacttttggagtaaccaccaccaaagtatcaaaatcaccaagtccagcaagtacttccacagtacctaacatgacagatgctcctacagcccccaaagcaggaactacaactgtggcaccaagtgcaccagacatttctgctaattctagaagtttatctcagattctgatggaacaattgcaaaaggagaaacagctggtcactggtatggatggtggccctgaggaatgcaaaaataaagatgatcagggatttgaatcatgtgaaaaggtatcaaattctgacaagcctttgatacaagatagtgacttgaaaacatctgatgccttacagttagaaaattctcaggaaattgaaacttctaataaaaatgatatgactatagatatactacatgctgatggtgaaagacctaatgttctagaaaacctagacaactcaaaggaaaagactgttggatcagaagcagcaaaaactgaagatacagttctctgcagcagtgatacagatgaggagtgtttaatcattgatacagaatgtaaaaaaaccagttataacagtgtttaatttagataagtttgagggaaaataatcagtaggcaagaggaacatttttcctgtagtagctagagtgccttgaaaaaatgtgttggctatgtgaaggaatatttcaactaaaatggaatggtatgcttttcacccttaaagtttgaggaggatcttgatatgttttaacattatcatggcagggaaatatataaagaagaaaaatatttttacattaaaccttttctaaaaattgtaaatagaaaaataatttggttttttatcaagaacaacacttatcgttatgtattgtgttagttatattgccagtctgttgcgactgactcaaaaagttaaatgttgccactgctgaagatgattatgagcatcgcaaactttgtttctgacccattttgacagtttttatatactcctttaaaatgatgaatgttacaggttaataaagttaatacctttaaa

SEQ ID NO: 62 - protein, 592 aa, Homo Sapien [sequence omitted]

SEQ ID NO: 63 - DNA, 1451 bp, Homo Sapien
tttttaacttgaacttccaaggccacgtgcgtctcctggctcctgcacggactgtgtgactgtccccgacagctttcctgtctcgtctcatgaggggtccagcacatggcattctgggtcggcacctgaagtccacctctatgagaccctctgggagcgtgacggggccttggcatgggtcggccgaggcccttctgtcccaggtcactggtgtggtcggcccaggccctcctgtcccacatcacctgtgtggtcggcccaggccctcctgtcccaggtcaccggtgtggtcggcccaggccctcctgtccaggtcctcctgtccaggtcactggtgtggtcggcccaggcccttctgtcccaggtcacctgtgtggtcggcccagggccctcctgtaccatgtcactgttgaggggctggctctggaagagggcagggacttggcattggtgggggcagggttccaaggtgtggcctgtcagcaggaaggggcaggtggcatgggtccaggcgggactcagggctggggtgccactgctggagactgtccggaggcccctccagggcaccttgccattgccattgtcgctcatggccatctggtcccgtttcagggaacaagaggaggatcagatgctgcgggacatgattgagaagctgggtgactgggccggggatgctgagggctgggctggctggctgggtgggccggggatgctgagtgctgggctggctggctgggtggaccgggcctccagctgggggtggggggggggcgggtatcgggtccccccctcagccttggtgacaggacaggcaggttcaccctgagggtgagagctccctcccgcccctaagagagccaggggcagctggtgaccgtgtggtcatggtggggaccagccctccggggcacccagtcggggcaggttctcacgtgggagggcacagggcttcctgcaggctcggaggcccagggcggattgtggccagtggaagggaaggatgtttctggcagggggacttgtgtgggccacggctgtgcggctgcggcgttgagcacggcctcactgtccacctgtcccctaggcctccagaggaagaagtccaagttccgcttgtccaagatctggtcaccaaaaagcaaaagcagcccctcccagtagtagccagtagggccgtgggctcggcccggacctggcatccggacttggactcggggccatgggcttggcccggacccggaacccggacttgtactcggggccgtgggctcggcccggacccggcattcggacttggactcgggaagggcctcctgtccctacaaggggcatgtggacagcagggacctgcgctaccgtctgtggtctcaataaagaaaccgaccacatggccccggaaaaaaaaaaaaaaaaaaaaaaaaaaaaaaaaaaaaaaaaaaaaaaca

SEQ ID NO: 64 - protein, 159 aa, Homo Sapien
MGRPRPFCPRSLVWSAQALLSHITCVVGPGPPVPGHRCGRPRPSCPGPPVQVTGVVGPGPSVPGHLCGRPRALLYHVTVEGLALEEGRDLALVGAGFQGVACQQEGAGGMGPGGTQGWGATAGDCPEAPPGHLAIAIVAHGHLVPFQGTRGGSDAAGHD

SEQ ID NO: 65 - DNA, 1629 bp, Homo Sapien
ggcgaccaccgccgcctcctcacctggccattggtgcagcccgttcccggcggcgagagaaggcaggcgcgctccttgcgccacgccacaccgtcgggcccccgtcgggtccccctcgggccgcaatggtgggctccgcgcggctgggtccggcactcttgaccccctttgtaaccaccgcggcgggcacccagggagttcgagcaacgaagttggtgacctgccccgctcccaggcagtttgctgttggggctttcacggctgctggaagggcatggctgtttgtcccatcactgggcgccagcttctcaaagctacgttcacagcaacgcagtagggactttcgtggcaggctttttttaagagctgaaagaagggcgggagggtttacgtcctagggtgatgatttcctcaccagacagcgaagtatctattgggaaactccaggtgaccgcacctccttccgacagttcgccccggggcaagtttaccagctgcgtcagaaagcaggtttgcaaaatccttggagaacggcctgagctaaggactggggtcaggagggttttaaactcattctgattttcttgcaatcatatctcttgaaagtttttatattttccccaatatttttctgagttgctatatccaatgaaaacaatgctgatgtagaggtccaccagccaatgctttattggaagtcaacgaatgagaccgagggtggcccataatcaatctcggcacgcgggaatgtgaacctcttccaaggtctgggcgagtccctagagttacgcagatgaaggacattggccctcgagaatctcacaccagcaaagaagagcacaacgaagcgcaaactacttatgatcattgtggctttgggcaagttgttgtagctcccagcaacaatttcttcacctggagtgcagcaataaatgatactggtgctgcagggcagctaataagcttctgaataatatatgcaaagtacttggcaccatgagcagaactcagtataccgtcactgaagaaatagcttatttaatgattacacttttcatatgtgcaagtaaaagtttgacttttagggagagcctcacctacggaatgtcttttttaaatttcttttttaattatactttaagttctgggatacatgtgcagaacgtgcaggtttgttacacaggtatacatgtgccatggtggtttgcagcacccatcaacccttcatctaggttttaagctccgcatgcattagttatttgtcctaatgctctccctccccttgtcccccaccccccaacaggcctcagggtgtgatgttcccctccctgggtccatatgttctcattgttcaactcccacttatgatgagaacatgcagtgtttggttttctgttcctgtgttagtttgctgagaatgatggtttccagcatcatccacgtccctgcaaaggacatgaattcattcttttttatggctgcatggtattccatggtgtatatgtgccacattttcttcatccagtctatcattgatgggcacttgggttggttccaagactttgttattgtgaacagtgctgcaataaacatacgtttgtatgtgtcaaaaaaaaaaaaaaaaaaaaa

SEQ ID NO: 66 - protein, 90 aa, Homo Sapien [sequence omitted]

SEQ ID NO: 67 - DNA, 2067 bp, Homo Sapien
catgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgatgccacatggaagagaaccagagagtggctcggcggcgaaggtttccgtttgtccgggagaggagtgactccactggctccagctctgtctacttcacggcctcctcgggagccacgttcacagatgctgagagtgaagggggttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgtatggaagccggcaggactttctctggcgcctggcccgagcctacagtgacatgtgtgagctcactgaggaggtgagcgagaagaagtcatatgccctagatggaaaagaagaagcagaggctgctctggagaagggggatgagagtgctgactgtcacctgtggtatgcggtgctttgtggtcagctggctgagcatgagagcatccagaggcgcatccagagtggctttagcttcaaggagcatgtggacaaagccattgctctccagccagaaaaccccatggctcactttcttcttggcaggtggtgctatcaggtctctcacctgagctggctagaaaaaaaaactgctacagccttgcttgaaagccctctcagtgccactgtggaagatgccctccagagcttcctaaaggctgaagaactacagccaggattttccaaagcaggaagggtatatatttccaagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgtt

SEQ ID NO: 68 - protein, 470 aa, Homo Sapien
MSRLGALGGARAGLGLLLGTAAGLGFLCLLYSQRWKRTQRHGRSQSLPNSLDYTQTSDPGRHVMLLRAVPGGAGDASVLPSLPREGQEKVLDRLDFVLTSLVALRREVEELRSSLRGLAGEIVGEVRCHMEENQRVARRRRFPFVRERSDSTGSSSVYFTASSGATFTDAESEGGYTTANAESDNERDSDKESEDGEDEVSCETVKMGRKDSLDLEEEAASGASSALEAGGSSGLEDVLPLLQQADELHRGDEQGKREGFQLLLNNKLVYGSRQDFLWRLARAYSDMCELTEEVSEKKSYALDGKEEAEAALEKGDESADCHLWYAVLCGQLAEHESIQRRIQSGFSFKEHVDKAIALQPENPMAHFLLGRWCYQVSHLSWLEKKTATALLESPLSATVEDALQSFLKAEELQPGFSKAGRVYISKCYRELGKNSEARWWMKLALELPDVTKEDLAIQKDLEELEVILRD

SEQ ID NO: 69 - DNA, 2250 bp, Homo Sapien
cccacgcgtccgaaacactttaaacctgaccagctaaatggataaacctagcctgcatagcttttaaactggggtctcatacagcacaggaggcctacttgcttcaagaactgaaaatccagaggatgaattgctttatctgggaatggcaaaagccagcacaataaggaatgccagtttgtatggggctactagctcacatgcgggatcagaatggtgtgaatgacagccgcactgtgtcatgaaggtggtggtggtttccgcacaagagaccaaataagaagaaagctgagagaggggggaaacgtttttggatgacaaaggatgggtttccatttaattacgcagctgaaaggcatgagtgtggtgctggtgctacttcctacactgctgcttgttatgctcacgggtgctcagagagcttgcccaaagaactgcagatgtgatggcaaaattgtgtactgtgagtctcatgctttcgcagatatccctgagaacatttctggagggtcacaaggcttatcattaaggttcaacagcattcagaagctcaaatccaatcagtttgccggccttaaccagcttatatggctttatcttgaccataattacattagctcagtggatgaagatgcatttcaagggatccgtagactgaaagaattaattctaagctccaacaaaattacttatctgcacaataaaacatttcacccagttcccaatctccgcaatctggacctctcctacaataagcttcagacattgcaatctgaacaatttaaaggccttcggaaactcatcattttgcacttgagatctaactcactaaagactgtgcccataagagtttttcaagactgtcggaatcttgattttttggatttgggttacaatcgtcttcgaagcttgtcccgaaatgcatttgctggcctcttgaagttaaaggagctccacctggagcacaaccagttttccaagatcaactttgctcattttccacgtctcttcaacctccgctcaatttacttacaatggaacaggattcgctccattagccaaggtttgacatggacttggagttccttacacaacttggatttatcagggaatgacatccaaggaattgagccgggcacatttaaatgcctccccaatttacaaaaattgaatttggattccaacaagctcaccaatatctcacaggaaactgtcaatgcgtggatatcattaatatccatcacattgtctggaaatatgtgggaatgcagtcggagcatttgtcctttattttattggcttaagaatttcaaaggaaataaggaaagcaccatgatatgtgcgggacctaagcacatccagggtgaaaaggttagtgatgcagtggaaacatataatatctgttctgaagtccaggtggtcaacacagaaagatcacacctggtgccccaaactccccagaaacctctgattatccctagacctaccatcttcaaacctgacgtcacccaatccacctttgaaacaccaagcccttccccagggtttcagattcctggcgcagagcaagagtatgagcatgtttcatttcacaaaattattgccgggagtgtggctctctttctctcagtggccatgatcctcttggtgatctatgtgtcttggaaacgctacccagccagcatgaaacaactccagcaacactctcttatgaagaggcggcggaaaaaggccagagagtctgaaagacaaatgaattcccctttacaggagtattatgtggactacaagcctacaaactctgagaccatggatatatcggttaatggatctgggccctgcacatataccatctctggctccagggaatgtgagatgccacaccacatgaagcccttgccatattacagctatgaccagcctgtgatcgggtactgccaggcccaccagccactccatgtcaccaagggctatgagacagtgtctccagagcaggacgaaagccccggcctggagctgggccgagaccacagcttcatcgccaccatcgccaggtcggcagcaccggccatctacctagagagaattgcaaactaacgctgaagccaactcctcactggggagctccatgggggggagggagggccttcatcttaaaggagaatgggtgtccacaatcgcgcaatcgagcaagctcatcgttcctgttaaaacatttatggcatagggaaaaaaaaaaaaaaaaaaaaa

SEQ ID NO: 70 - protein, 590 aa, Homo Sapien
MGFHLITQLKGMSVVLVLLPTLLLVMLTGAQRACPKNCRCDGKIVYCESHAFADIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHKIIAGSVALFLSVAMILLVIYVSWKRYPASMKQLQQHSLMKRRRKKARESERQMNSPLQEYYVDYKPTNSETMDISVNGSGPCTYTISGSRECEMPHHMKPLPYYSYDQPVIGYCQAHQPLHVTKGYETVSPEQDESPGLELGRDHSFIATIARSAAPAIYLERIAN

SEQ ID NO: 71 - DNA, 521 bp, Homo Sapien
ttccagtcagagttaagttaaaacagaaaaaaggaagatggcaagaatattgttacttttcctcccgggtcttgtggctgtatgtgctgtgcatggaatatttatggaccgtctagcttccaagaagctctgtgcagatgatgagtgtgtctatactatttctctggctagtgctcaagaagattataatgccccggactgtagattcattaacgttaaaaaagggcagcagatctatgtgtactcaaagctggtaaaagaaaatggagctggagaattttgggctggcagtgtttatggtgatggccaggacgagatgggagtcgtgggttatttccccaggaacttggtcaaggaacagcgtgtgtaccaggaagctaccaaggaagttcccaccacggatattgacttcttctgcgagtaataaattagttaaaactgcaaatagaaagaaaacaccaaaaataaagaaaagagcaaaagtggccaaaaaatgcatgtctgtaattttggactgacgt

SEQ ID NO: 72 - protein, 128 aa, Homo Sapien
MARILLLFLPGLVAVCAVHGIFMDRLASKKLCADDECVYTISLASAQEDYNAPDCRFINVKKGQQIYVYSKLVKENGAGEFWAGSVYGDGQDEMGVVGYFPRNLVKEQRVYQEATKEVPTTDIDFFCE

SEQ ID NO: 73 - DNA, 720 bp, Homo Sapien
ctcagatttgccatggagaaattttcagtctcggcaatcctgcttcttgtggccatctctggtactctggccaaagacaccacagtcaaatctggatccaaaaaggacccaaaggactctcgacccaaactaccccagaccctgtccagaggttggggagatcagctcatctggactcagacttacgaagaagccttatacaaatccaagacaagcaacagacccttgatggtcattcatcacttggacgaatgcccgcacagtcaagctttaaagaaagtgtttgctgaaaataaggagatccagaaattggcagagcagtttgttctcctcaacttgatctatgaaacaactgacaagcacctttctcctgatggccagtacgtccccagaattgtgtttgtggacccttccctgacggtgagggcagacatcaccggaagatactcaaaccgtctctacgcttatgaaccttctgacacagctctgttgcacgacaacatgaagaaagctctcaagttgctgaagacagagttgtagagtcaactgtacagtgcctcaggagccgggaaggcagaagcactgtggacctgccgatgacattacagtttaatgttacaacaaatgtattttttaaacacccacgtgtggggaaacaatattattatctactacagacacatgattttctagaaaataaagtcttgtgagaactccaaa

SEQ ID NO: 74 - protein, 175 aa, Homo Sapien
MEKFSVSAILLLVAISGTLAKDTTVKSGSKKDPKDSRPKLPQTLSRGWGDQLIWTQTYEEALYKSKTSNRPLMVIHHLDECPHSQALKKVFAENKEIQKLAEQFVLLNLIYETTDKHLSPDGQYVPRIVFVDPSLTVRADITGRYSNRLYAYEPSDTALLHDNMKKALKLLKTEL

SEQ ID NO: 75 - DNA, 776 bp, Homo Sapien
gccggcgccagggcaggcgggcggctggcagctgtggcgccgacatggctgcgctggtggagccgctggggctggagcgggacgtgtcccgggcggttgagctcctcgagcggctccagcgcagcggggagctgccgccgcagaagctgcaggccctccagcgagttctgcagagccgcttctgctccgctatccgagaggtgtatgagcagctttatgacacgctggacatcaccggcagcgccgagatccgagcccatgccacagccaaggccacagtggctgccttcacagccagcgagggccacgcacatcccagggtagtggagctacccaagacggatgagggcctaggcttcaacatcatgggtggcaaagagcaaaactcgcccatctacatctcccgggtcatcccagggggtgtggctgaccgccatggaggcctcaagcgtggggatcaactgttgtcggtgaacggtgtgagcgttgagggtgagcagcatgagaaggcggtggagctgctgaaggcggcccagggctcggtgaagctggttgtccgttacacaccgcgagtgctggaggagatggaggcccggttcgagaagatgcgctctgcccgccggcgccaacagcatcagagctactcgtccttggagtctcgaggttgaaaccacagatctggacgttcacgtgcactctcttcctgtacagtatttattgttcctggcactttatttaaagatatttgaccctcaaaaaaaaaaaaaaaaaaaaaa

SEQ ID NO: 76 - protein, 207 aa, Homo Sapien
MAALVEPLGLERDVSRAVELLERLQRSGELPPQKLQALQRVLQSRFCSAIREVYEQLYDTLDITGSAEIRAHATAKATVAAFTASEGHAHPRVVELPKTDEGLGFNIMGGKEQNSPIYISRVIPGGVADRHGGLKRGDQLLSVNGVSVEGEQHEKAVELLKAAQGSVKLVVRYTPRVLEEMEARFEKMRSARRRQQHQSYSSLESRG

SEQ ID NO: 77 - DNA, 939 bp, Homo Sapien
ctgtcagctgaggatccagccgaaagaggagccaggcactcaggccacctgagtctactcacctggacaactggaatctggcaccaattctaaaccactcagcttctccgagctcacaccccggagatcacctgaggacccgagccattgatggactcggacgagaccgggttcgagcactcaggactgtgggtttctgtgctggctggtctgctgggagcctgccaggcacaccccatccctgactccagtcctctcctgcaattcgggggccaagtccggcagcggtacctctacacagatgatgcccagcagacagaagcccacctggagatcagggaggatgggacggtggggggcgctgctgaccagagccccgaaagtctcctgcagctgaaagccttgaagccgggagttattcaaatcttgggagtcaagacatccaggttcctgtgccagcggccagatggggccctgtatggatcgctccactttgaccctgaggcctgcagcttccgggagctgcttcttgaggacggatacaatgtttaccagtccgaagcccacggcctcccgctgcacctgccagggaacaagtccccacaccgggaccctgcaccccgaggaccagctcgcttcctgccactaccaggcctgccccccgcactcccggagccacccggaatcctggccccccagccccccgatgtgggctcctcggaccctctgagcatggtgggaccttcccagggccgaagccccagctacgcttcctgaagccagaggctgtttactatgacatctcctctttatttattaggttatttatcttatttatttttttatttttcttacttgagataataaagagttccagaggagaaaaaaaaaaaaaaaaaaaaaaaaaaaaaaaaaaaaaaaaaaaaaaaaaaaaaaaag

SEQ ID NO: 78 - protein, 208 aa, Homo Sapien
MDSDETGFEHSGLWVSVLAGLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 79 - DNA, 2732 bp, Homo Sapien
agtcccagacgggcttttcccagagagctaaaagagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaaaaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccggtcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgagaaaaaaaaaaaaaaaaaaaaaaaaaaaaaaaaaaaaaaaaaaaaaaaaaaaaaaaaaaaaaaaaaaaaa

SEQ ID NO: 80 - protein, 667 aa, Homo Sapien
MSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 81 - DNA, 1186 bp, Homo Sapien
aaaaaatacagcaggtgaaggaggttggagagtagggggtggagggcccacgcagcacttgtccttcaccctggaggggatctgttacatgccccagattgctggtcccctagaaatgttactgaggcagcctctgcatttttgcagggattgttttctactgtttgacattcacgtaacctcctaacgctgtctggggaagatgctaccccctgctctccccgtctttcctgcactctcagcaatgggatgggctgactgatgccctgtgggctggaaagctgaccacagttgctgcagaccagaccccctcacatagtgagtgctgggctgaggaatccaggagagcccgaggggggacactgaaggtgtatcgttggccctgccagctgcaagtgaactgcttctgatgaattttaatagggagaaagaagtatttgctaagaatggcaatcctgacgctcagccttcaactcatcttgttattaataccatcaatatcccatgaggctcataaaacgagtctttcttcttggaaacatgaccaagattgggcaaacgtctccaacatgactttcagcaacggaaaactaagagtcaaaggcatttattaccggaatgccgacatttgctctcgacatcgcgtaacctcagcaggcctaactctgcaggaccttcagctatggtgtaatttgaggtcagtggccagaggacagatcccgtctacattatgagtgaagcggagagctactgcagggttctgagcagagtcctaatttatattttagaagaatcatcatggctcctagattaggaataaaacgaaggggcccagggatggaaacgatgagtccagttgggttactgcaaagatccaggccagaaatccaggcacagtggcacacacctgagtcccagataattccacctactggtcctgctctgtggcctactggtccgagtccagccccgactgatttctgggcctgtaatgtctaaaaacgctccctgctgatgttttgcaagtgactgtgttacttgaaggcagttcctaggataaactagtcgctttatcattacagaatcattcactgagcatcaactatgtaaccagcattgggttgggtgccagagatccaaagctaagacaccaaaacctgctctccaggaaacgagaggctgagaa

SEQ ID NO: 82 - protein, 95 aa, Homo Sapien [sequence omitted]

SEQ ID NO: 83 - DNA, 1677 bp, Homo Sapien
aatagaagtcctcaggacggagcagaggtggccggcgggcccggctgactgcgcctctgctttctttccataaccttttctttcggactcgaatcacggctgctgcgaagggtctagttccggacactagggtgcccgaacgcgctgatgccccgagtgctcgcagggcttcccgctaaccatgctgccgccgccgcggcccgcagctgccttggcgctgcctgtgctcctgctactgctggtggtgctgacgccgcccccgaccggcgcaaggccatccccaggcccagattacctgcggcgcggctggatgcggctgctagcggagggcgagggctgcgctccctgccggccagaagagtgcgccgcgccgcggggctgcctggcgggcagggtgcgcgacgcgtgcggctgctgctgggaatgcgccaacctcgagggccagctctgcgacctggaccccagtgctcacttctacgggcactgcggcgagcagcttgagtgccggctggacacaggcggcgacctgagccgcggagaggtgccggaacctctgtgtgcctgtcgttcgcagagtccgctctgcgggtccgacggtcacacctactcccagatctgccgcctgcaggaggcggcccgcgctcggcccgatgccaacctcactgtggcacacccggggccctgcgaatcggggccccagatcgtgtcacatccatatgacacttggaatgtgacagggcaggatgtgatctttggctgtgaagtgtttgcctaccccatggcctccatcgagtggaggaaggatggcttggacatccagctgccaggggatgacccccacatctctgtgcagtttaggggtggaccccagaggtttgaggtgactggctggctgcagatccaggctgtgcgtcccagtgatgagggcacttaccgctgccttggccgcaatgccctgggtcaagtggaggcccctgctagcttgacagtgctcacacctgaccagctgaactctacaggcatcccccagctgcgatcactaaacctggttcctgaggaggaggctgagagtgaagagaatgacgattactactaggtccagagctctggcccatgggggtgggtgagcggctatagtgttcatccctgctcttgaaaagacctggaaaggggagcagggtcccttcatcgactgctttcatgctgtcagtagggatgatcatgggaggcctatttgactccaaggtagcagtgtggtaggatagagacaaaagctggaggagggtagggagagaagctgagaccaggaccggtggggtacaaaggggcccatgcaggagatgccctggccagtaggacctccaacaggttgtttcccaggctggggtgggggcctgagcagacacagaggtgcaggcaccaggattctccacttcttccagccctgctgggccacagttctaactgcccttcctcccaggccctggttcttgctatttcctggtccccaacgtttatctagcttgtttgccctttccccaaactcatcttccagaacttttccctctctcctaagccccagttgcacctactaactgcagtcccttttgctgtctgccgtcttttgtacaagagagagaacagcggagcatgacttagttcagtgcagagagattt

SEQ ID NO: 84 - protein, 304 aa, Homo Sapien
MLPPPRPAAALALPVLLLLLVVLTPPPTGARPSPGPDYLRRGWMRLLAEGEGCAPCRPEECAAPRGCLAGRVRDACGCCWECANLEGQLCDLDPSAHFYGHCGEQLECRLDTGGDLSRGEVPEPLCACRSQSPLCGSDGHTYSQICRLQEAARARPDANLTVAHPGPCESGPQIVSHPYDTWNVTGQDVIFGCEVFAYPMASIEWRKDGLDIQLPGDDPHISVQFRGGPQRFEVTGWLQIQAVRPSDEGTYRCLGRNALGQVEAPASLTVLTPDQLNSTGIPQLRSLNLVPEEEAESEENDDYY

SEQ ID NO: 85 - DNA, 1285 bp, Homo Sapien
caaagcggcggctgtccgcggtgccggctgggggcggagaggcggcggtgggctccctggggtgtgtgagcccggtgatggagccgggcccgacagccgcgcagcggaggtgttcgttgccgccgtggctgccgctggggctgctgctgtggtcggggctggccctgggcgcgctccccttcggcagcagtccgcacagggtcttccacgacctcctgtcggagcagcagttgctggaggtggaggacttgtccctgtccctcctgcagggtggagggctggggcctctgtcgctgcccccggacctgccggatctggatcctgagtgccgggagctcctgctggacttcgccaacagcagcgcagagctgacagggtgtctggtgcgcagcgcccggcccgtgcgcctctgtcagacctgctaccccctcttccaacaggtcgtcagcaagatggacaacatcagccgagccgcggggaatacttcagagagtcagagttgtgccagaagtctcttaatggcagatagaatgcaaatagttgtgattctctcagaattttttaataccacatggcaggaggcaaattgtgcaaattgtttaacaaacaacagtgaagaattatcaaacagcacagtatatttccttaatctatttaatcacaccctgacctgctttgaacataaccttcaggggaatgcacatagtcttttacagacaaaaaattattcagaagtatgcaaaaactgccgtgaagcatacaaaactctgagtagtctgtacagtgaaatgcaaaaaatgaatgaacttgagaataaggctgaacctggaacacatttatgcattgatgtggaagatgcaatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcccaaacgtctcaagtccagtaccagttttgcaaatattcaggaaaattcaaactgagacctacaaaatggagaattgacatatcacgtgaatgaatggtggaagacacaacttggtttcagaaagaagataaactgtgatttgacaagtcaagctcttaagaaatacaaggacttcagatccatttttaaataagaattttcgatttttctttccttttccacttctttctaacagatttggatatttttaatttccag

SEQ ID NO: 86 - protein, 334 aa, Homo Sapien
MEPGPTAAQRRCSLPPWLPLGLLLWSGLALGALPFGSSPHRVFHDLLSEQQLLEVEDLSLSLLQGGGLGPLSLPPDLPDLDPECRELLLDFANSSAELTGCLVRSARPVRLCQTCYPLFQQVVSKMDNISRAAGNTSESQSCARSLLMADRMQIVVILSEFFNTTWQEANCANCLTNNSEELSNSTVYFLNLFNHTLTCFEHNLQGNAHSLLQTKNYSEVCKNCREAYKTLSSLYSEMQKMNELENKAEPGTHLCIDVEDAMNITRKLWSRTFNCSVPCSDTVPVIAVSVFILFLPVVFYLSSFLHSEQKKRKLILPKRLKSSTSFANIQENSN

SEQ ID NO: 87 - DNA, 1754 bp, Homo Sapien
atgctggtagccggcttcctgctggcgctgccgccgagctgggccgcgggcgcccccagggcgggcaggcgccccgcgcggccgcggggctgcgcggaccggccggaggagctactggagcagctgtacgggcgcctggcggccggcgtgctcagtgccttccaccacacgctgcagctggggccgcgtgagcaggcgcgcaacgcgagctgcccggcagggggcaggcccggcgaccgccgcttccggccgcccaccaacctgcgcagcgtgtcgccctgggcctacagaatctcctacgacccggcgaggtaccccaggtacctgcctgaagcctactgcctgtgccggggctgcctgaccgggctgttcggcgaggaggacgtgcgcttccgcagcgcccctgtctacatgcccaccgtcgtcctgcgccgcacccccgcctgcgccggcggccgttccgtctacaccgaggcctacgtcaccatccccgtgggctgcacctgcgtccccgagccggagaaggacgcagacagcatcaactccagcatcgacaaacagggcgccaagctcctgctgggccccaacgacgcgcccgctggcccctgaggccggtcctgccccgggaggtctccccggcccgcatcccgaggcgcccaagctggagccgcctggagggctcggtcggcgacctctgaagagagtgcaccgagcaaaccaagtgccggagcaccagcgccgcctttccatggagactcgtaagcagcttcatctgacacgggcatccctggcttgcttttagctacaagcaagcagcgtggctggaagctgatgggaaacgacccggcacgggcatcctgtgtgcggcccgcatggagggtttggaaaagttcacggaggctccctgaggagcctctcagatcggctgctgcgggtgcagggcgtgactcaccgctgggtgcttgccaaagagatagggacgcatatgctttttaaagcaatctaaaaataataataagtatagcgactatatacctacttttaaaatcaactgttttgaatagaggcagagctattttatattatcaaatgagagctactctgttacatttcttaacatataaacatcgttttttacttcttctggtagaattttttaaagcataattggaatccttggataaattttgtagctggtacactctggcctgggtctctgaattcagcctgtcaccgatggctgactgatgaaatggacacgtctcatctgacccactcttccttccactgaaggtcttcacgggcctccaggtggaccaaagggatgcacaggcggctcgcatgccccagggccagctaagagttccaaagatctcagatttggttttagtcatgaatacataaacagtctcaaactcgcacaattttttcccccttttgaaagccactggggccaatttgtggttaagaggtggtgagataagaagtggaacgtgacatctttgccagttgtcagaagaatccaagcaggtattggcttagttgtaagggctttaggatcaggctgaatatgaggacaaagtgggccacgttagcatctgcagagatcaatctggaggcttctgtttctgcattctgccacgagagctaggtccttgatcttttctttagattgaaagtctgtctctgaacacaattatttgtaaaagttagtagttcttttttaaatcattaaaagaggcttgctgaaggat

SEQ ID NO: 88 - protein, 202 aa, Homo Sapien [sequence omitted]

SEQ ID NO: 89 - DNA, 2601 bp, Homo Sapien
ccggggcctccggagaacgctgtcccatgaacgtgcggggagcggcccccggcgtccgcgcgtccccgcgtccctggcaattcccgacttcccaacggcttcccgctggcagccccgaagccgcaccatgttccgcctctggttgctgctggccgggctctgcggcctcctggcgtcaagacccggttttcaaaattcacttctacagatcgtaattccagagaaaatccaaacaaatacaaatgacagttcagaaatagaatatgaacaaatatcctatattattccaatagatgagaaactgtacactgtgcaccttaaacaaagatattttttagcagataattttatgatctatttgtacaatcaaggatctatgaatacttattcttcagatattcagactcaatgctactatcaaggaaatattgaaggatatccagattccatggtcacactcagcacgtgctctggactaagaggaatactgcaatttgaaaatgtttcttatggaattgagcctctggaatctgcagttgaatttcagcatgttctttacaaattaaagaatgaagacaatgatattgcaatttttattgacagaagcctgaaagaacaaccaatggatgacaacatttttataagtgaaaaatcagaaccagctgttccagatttatttcctctttatctagaaatgcatattgtggtggacaaaactttgtatgattactggggctctgatagcatgatagtaacaaataaagtcatcgaaattgttggccttgcaaattcaatgttcacccaatttaaagttactattgtgctgtcatcattggagttatggtcagatgaaaataagatttctacagttggtgaggcagatgaattattgcaaaaatttttagaatggaaacaatcttatcttaacctaaggcctcatgatattgcatatctactaatttatatggattatcctcgttatttgggagcagtgtttcctggaacaatgtgtattactcgttattctgcaggagttgcattgtaccccaaggagataactctggaggcatttgcagttattgtcacccagatgctggcactcagtctgggaatatcatatgacgacccaaagaaatgtcaatgttcagaatccacctgtataatgaatccagaagttgtgcaatccaatggtgtgaagacttttagcagttgcagtttgaggagctttcaaaatttcatttcaaatgtgggtgtcaaatgtcttcagaataagccacaaatgcaaaaaaaatctccgaaaccagtctgtggcaatggcagattggagggaaatgaaatctgtgattgtggtactgaggctcaatgtggacctgcaagctgttgtgattttcgaacttgtgtactgaaagacggagcaaaatgttataaaggactgtgctgcaaagactgtcaaattttacaatcaggcgttgaatgtaggccgaaagcacatcctgaatgtgacatcgctgaaaattgtaatggaagctcaccagaatgtggtcctgacataactttaatcaatggactttcatgcaaaaataataagtttatttgttatgacggagactgccatgatctcgatgcacgttgtgagagtgtatttggaaaaggttcaagaaatgctccatttgcctgctatgaagaaatacaatctcaatcagacagatttgggaactgtggtagggatagaaataacaaatatgtgttctgtggatggaggaatcttatatgtggaagattagtttgtacctaccctactcgaaagcctttccatcaagaaaatggtgatgtgatttatgctttcgtacgagattctgtatgcataactgtagactacaaattgcctcgaacagttccagatccactggctgtcaaaaatggctctcagtgtgatattgggagggtttgtgtaaatcgtgaatgtgtagaatcaaggataattaaggcttcagcacatgtttgttcacaacagtgttctggacatggagtgtgtgattccagaaacaagtgccattgttcgccaggctataagcctccaaactgccaaatacgttccaaaggattttccatatttcctgaggaagatatgggttcaatcatggaaagagcatctgggaagactgaaaacacctggcttctaggtttcctcattgctcttcctattctcattgtaacaaccgcaatagttttggcaaggaaacagttgaaaaagtggttcgccaaggaagaggaattcccaagtagcgaatctaaatcggaaggtagcacacagacatatgccagccaatccagctcagaaggcagcactcagacatatgccagccaaaccagatcagaaagcagcagtcaagctgatactagcaaatccaaatcagaagatagtgctgaagcatatactagcagatccaaatcacaggacagtacccaaacacaaagcagtagtaactagtgattccttcagaaggcaacggataacatcgagagtctcgctaagaaatgaaaattctgtctttccttccgtggtcacagctgaaagaaacaataaattgagtgtggatc

SEQ ID NO: 90 - protein, 787 aa, Homo Sapien
MFRLWLLLAGLCGLLASRPGFQNSLLQIVIPEKIQTNTNDSSEIEYEQISYIIPIDEKLYTVHLKQRYFLADNFMIYLYNQGSMNTYSSDIQTQCYYQGNIEGYPDSMVTLSTCSGLRGILQFENVSYGIEPLESAVEFQHVLYKLKNEDNDIAIFIDRSLKEQPMDDNIFISEKSEPAVPDLFPLYLEMHIVVDKTLYDYWGSDSMIVTNKVIEIVGLANSMFTQFKVTIVLSSLELWSDENKISTVGEADELLQKFLEWKQSYLNLRPHDIAYLLIYMDYPRYLGAVFPGTMCITRYSAGVALYPKEITLEAFAVIVTQMLALSLGISYDDPKKCQCSESTCIMNPEVVQSNGVKTFSSCSLRSFQNFISNVGVKCLQNKPQMQKKSPKPVCGNGRLEGNEICDCGTEAQCGPASCCDFRTCVLKDGAKCYKGLCCKDCQILQSGVECRPKAHPECDIAENCNGSSPECGPDITLINGLSCKNNKFICYDGDCHDLDARCESVFGKGSRNAPFACYEEIQSQSDRFGNCGRDRNNKYVFCGWRNLICGRLVCTYPTRKPFHQENGDVIYAFVRDSVCITVDYKLPRTVPDPLAVKNGSQCDIGRVCVNRECVESRIIKASAHVCSQQCSGHGVCDSRNKCHCSPGYKPPNCQIRSKGFSIFPEEDMGSIMERASGKTENTWLLGFLIALPILIVTTAIVLARKQLKKWFAKEEEFPSSESKSEGSTQTYASQSSSEGSTQTYASQTRSESSSQADTSKSKSEDSAEAYTSRSKSQDSTQTQSSSN

SEQ ID NO: 91 - DNA, 2445 bp, Homo Sapien
  unsure 2424: unknown base
caccagacagcactccagcactctgtttggggggcattcgaaacagcaaaatcactcataaaaggcaaaaaattgcaaaaaaaaatagtaataaccagcatggcactaaatagaccatgaaaagacatgtgtgtgcagtatgaaaattgagacaggaaggcagagtgtcagcttgttccacctcagctgggaatgtgcatcaggcaactcaagtttttcaccacggcatgtgtctgtgaatgtccgcaaaacattctctctccccagccttcatgtgttaacctggggatgatgtggacctgggcactgtggatgctcccttcactctgcaaattcagcctggcagctctgccagctaagcctgagaacatttcctgtgtctactactataggaaaaatttaacctgcacttggagtccaggaaaggaaaccagttatacccagtacacagttaagagaacttacgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacatagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctggatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaagctccatgtggcctggaactgtggagagtcctgaaaccagctgaggcggatggaagaaggccagtgcggttgttatggaagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatcatttcagtgcattgaggtcatgcaggcctgcgttgctgaggaccagctagtggtgaagtggcaaagctctgctctagacgtgaacacttggatgattgaatggtttccggatgtggactcagagcccaccaccctttcctgggaatctgtgtctcaggccacgaactggacgatccagcaagataaattaaaacctttctggtgctataacatctctgtgtatccaatgttgcatgacaaagttggcgagccatattccatccaggcttatgccaaagaaggcgttccatcagaaggtcctgagaccaaggtggagaacattggcgtgaagacggtcacgatcacatggaaagagattcccaagagtgagagaaagggtatcatctgcaactacaccatcttttaccaagctgaaggtggaaaaggattctgtaagcacgcccatagcgaagtggaaaaaaaccccaagccccagatagatgctatggatagacctgttgtaggcatggctcccccatctcattgtgacttgcaacctggcatgaatcacttagcttctttaaatctctctgaaaatggggccaagagcacccaccttttggggttttgggggttaaatgagagtgaagtgacagtacctgagaggagagtcctgaggaaatggaaggagttgttataatttgtcctggttaggccctgaattgacctcccgggagctccccgaccatcattcccaggaatggcgtgcctggcttaaagagtgaggaggaacagaccctgtcaccatgacttctactgcccctgccaaatcatgcttttgtttttcagtccaccttatctcctgacatcttaaatactgggcaaggcttggattcttgcttaggctaaataattttttcttatggtaaaatacacgtaaaatatttttccagtttaaacatttgaaagtgtacaatttagtggcattagaagcattcacaatattgtgcaaccatcaccactatttccagaactcttctatttctgcccaaatagaagccctatacccattcattagtcactccccattcctctcctcccacagcccctggcaactaccaaactgctttgtgtctctatggattgcctattttggatatttcatatacatagaatcataaantaaaaaaaaaaaaaaaaaaaa

SEQ ID NO: 92 - protein, 582 aa, Homo Sapien
MCIRQLKFFTTACVCECPQNILSPQPSCVNLGMMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFCKHAHSEVEKNPKPQIDAMDRPVVGMAPPSHCDLQPGMNHLASLNLSENGAKSTHLLGFWGLNESEVTVPERRVLRKWKELL

SEQ ID NO: 93 - DNA, 662 bp, Homo Sapien
attctcctagagcatctttggaagcatgaggccacgatgctgcatcttggctcttgtctgctggataacagtcttcctcctccagtgttcaaaaggaactacagacgctcctgttggctcaggactgtggctgtgccagccgacacccaggtgtgggaacaagatctacaacccttcagagcagtgctgttatgatgatgccatcttatccttaaaggagacccgccgctgtggctccacctgcaccttctggccctgctttgagctctgctgtcccgagtcttttggcccccagcagaagtttcttgtgaagttgagggttctgggtatgaagtctcagtgtcacttatctcccatctcccggagctgtaccaggaacaggaggcacgtcctgtacccataaaaaccccaggctccactggcagacggcagacaaggggagaagagacgaagcagctggacatcggagactacagttgaacttcggagagaagcaacttgacttcagagggatggctcaatgacatagctttggagaggagcccagctggggatggccagacttcaggggaagaatgccttcctgcttcatcccctttccagctccccttcccgctgagagccactttcatcggcaataaaatcccccacatttaccatct

SEQ ID NO: 94 - protein, 125 aa, Homo Sapien
MRPRCCILALVCWITVFLLQCSKGTTDAPVGSGLWLCQPTPRCGNKIYNPSEQCCYDDAILSLKETRRCGSTCTFWPCFELCCPESFGPQQKFLVKLRVLGMKSQCHLSPISRSCTRNRRHVLYP

SEQ ID NO: 95 - DNA, 471 bp, Homo Sapien
gcatttttgtctgtgctccctgatcttcaggtcaccaccatgaagttcttagcagtcctggtactcttgggagtttccatctttctggtctctgcccagaatccgacaacagctgctccagctgacacgtatccagctactggtcctgctgatgatgaagcccctgatgctgaaaccactgctgctgcaaccactgcgaccactgctgctcctaccactgcaaccaccgctgcttctaccactgctcgtaaagacattccagttttacccaaatgggttggggatctcccgaatggtagagtgtgtccctgagatggaatcagcttgagtcttctgcaattggtcacaactattcatgcttcctgtgatttcatccaactacttaccttgcctacgatatcccctttatctctaatcagtttattttctttcaaataaaaaataactatgagcaacataaaaaaaaaaaaa

SEQ ID NO: 96 - protein, 90 aa, Homo Sapien
MKFLAVLVLLGVSIFLVSAQNPTTAAPADTYPATGPADDEAPDAETTAAATTATTAAPTTATTAASTTARKDIPVLPKWVGDLPNGRVCP

SEQ ID NO: 97 - DNA, 907 bp, Homo Sapien
ggactctgaaggtcccaagcagctgctgaggcccccaaggaagtggttccaaccttggacccctaggggtctggatttgctggttaacaagataacctgagggcaggaccccataggggaatgctacctcctgcccttccacctgccctggtgttcacggtggcctggtccctccttgccgagagagtgtcctgggtcagggacgcagaggacgctcacagactccagccctttgttaccgagaggacacttggcaaggtccagcgatggtccggagtccacacacagactggcggcagggcaggagggggacagttctgttgtgcttggttggacagtaagagggtcttggccagtccagggtggggggcggcaaactccataaagaaccagagggtctgggccccggccacagagtcatctgcccagctcctctgctgctggccagtgggagtggcacgaggtggggctttgtgccagtaaaaccacaggctggatttgcctgcgggccatggtccctgtctagggcagcaattctcaaccttcttgctctcaggaccccaaagagctttcattgtatctattgatttttaccacattagcaattaaaactgagaaatgggccgggcacggtggctcacgcctgtaatcccagcactttgggaggccgaggcgggtggatcacctgagatcaggagttcaagaccagcctggccaacatggtgaaaccttgtctactaaaaatacaaaaaattagccaggcacagtggtgtgcactggtagtcccagttactcgggaggctgaggcaggaaaatcgcttgaacccaggaggcggacgttgcggtgagccgagatcgcgccgctgattccagcctgggcgacaagagtgagactccatctcacaca

SEQ ID NO: 98 - protein, 120 aa, Homo Sapien
MLPPALPPALVFTVAWSLLAERVSWVRDAEDAHRLQPFVTERTLGKVQRWSGVHTQTGGRAGGGQFCCAWLDSKRVLASPGWGAANSIKNQRVWAPATESSAQLLCCWPVGVARGGALCQ

SEQ ID NO: 99 - DNA, 1073 bp, Homo Sapien
aatttttcaccagagtaaacttgagaaaccaactggaccttgagtattgtacattttgcctcgtggacccaaaggtagcaatctgaaacatgaggagtacgattctactgttttgtcttctaggatcaactcggtcattaccacagctcaaacctgctttgggactccctcccacaaaactggctccggatcagggaacactaccaaaccaacagcagtcaaatcaggtctttccttctttaagtctgataccattaacacagatgctcacactggggccagatctgcatctgttaaatcctgctgcaggaatgacacctggtacccagacccacccattgaccctgggagggttgaatgtacaacagcaactgcacccacatgtgttaccaatttttgtcacacaacttggagcccagggcactatcctaagctcagaggaattgccacaaatcttcacgagcctcatcatccattccttgttcccgggaggcatcctgcccaccagtcaggcaggggctaatccagatgtccaggatggaagccttccagcaggaggagcaggtgtaaatcctgccacccagggaaccccagcaggccgcctcccaactcccagtggcacagatgacgactttgcagtgaccacccctgcaggcatccaaaggagcacacatgccatcgaggaagccaccacagaatcagcaaatggaattcagtaagctgtttcaaattttttcaactaagctgcctcgaatttggtgatacatgtgaatctttatcattgattatattatggaatagattgagacacattggatagtcttagaagaaattaattcttaatttacctgaaaatattcttgaaatttcagaaaatatgttctatgtagagaatcccaacttttaaaaacaataattcaatggataaatctgtctttgaaatataacattatgctgcctggatgatatgcatattaaaacatatttggaaaactggaaaaaaaaaaaaaaaaaaaaaaaaaaaaaaaaaaaaaaaaaaaaaaaaaaaaaaaaaaaaaaaaaaaaaaaaaaaa

SEQ ID NO: 100 - protein, 209 aa, Homo Sapien
MRSTILLFCLLGSTRSLPQLKPALGLPPTKLAPDQGTLPNQQQSNQVFPSLSLIPLTQMLTLGPDLHLLNPAAGMTPGTQTHPLTLGGLNVQQQLHPHVLPIFVTQLGAQGTILSSEELPQIFTSLIIHSLFPGGILPTSQAGANPDVQDGSLPAGGAGVNPATQGTPAGRLPTPSGTDDDFAVTTPAGIQRSTHAIEEATTESANGIQ

SEQ ID NO: 101 - DNA, 1514 bp, Homo Sapien
ggggtctccctcagggccgggaggcacagcggtccctgcttgctgaagggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggtagagtggaacccccagctattagaggtcccaccccaaactcagtttgattacacagtcaccaatctagctggtggtccgaaaccatattctccttacgactctcaataccatgagaccaccctgaaggggggcatgtttgctgggcagctgaccaaggtgggcatgcagcaaatgtttgccttgggagagagactgaggaagaactatgtggaagacattccctttctttcaccaaccttcaacccacaggaggtctttattcgttccactaacatttttcggaatctggagtccacccgttgtttgctggctgggcttttccagtgtcagaaagaaggacccatcatcatccacactgatgaagcagattcagaagtcttgtatcccaactaccaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggcacacaacctcccaagctgccccatgctgaagagatttgcacggatgatcgaacagagagctgtggacacatccttgtacatactgcccaaggaagacagggaaagtcttcagatggcagtaggcccattcctccacatcctagagagcaacctgctgaaagccatggactctgccactgcccccgacaagatcagaaagctgtatctctatgcggctcatgatgtgaccttcataccgctcttaatgaccctggggatttttgaccacaaatggccaccgtttgctgttgacctgaccatggaactttaccagcacctggaatctaaggagtggtttgtgcagctctattaccacgggaaggagcaggtgccgagaggttgccctgatgggctctgcccgctggacatgttcttgaatgccatgtcagtttataccttaagcccagaaaaataccatgcactctgctctcaaactcaggtgatggaagttggaaatgaagagtaactgatttataaaagcaggatgtgttgattttaaaataaagtgcctttatacaatg

SEQ ID NO: 102 - protein, 428 aa, Homo Sapien
MITGVFSMRLWTPVGVLTSLAYCLHQRRVALAELQEADGQCPVDRSLLKLKMVQVVFRHGARSPLKPLPLEEQVEWNPQLLEVPPQTQFDYTVTNLAGGPKPYSPYDSQYHETTLKGGMFAGQLTKVGMQQMFALGERLRKNYVEDIPFLSPTFNPQEVFIRSTNIFRNLESTRCLLAGLFQCQKEGPIIIHTDEADSEVLYPNYQSCWSLRQRTRGRRQTASLQPGISEDLKKVKDRMGIDSSDKVDFFILLDNVAAEQAHNLPSCPMLKRFARMIEQRAVDTSLYILPKEDRESLQMAVGPFLHILESNLLKAMDSATAPDKIRKLYLYAAHDVTFIPLLMTLGIFDHKWPPFAVDLTMELYQHLESKEWFVQLYYHGKEQVPRGCPDGLCPLDMFLNAMSVYTLSPEKYHALCSQTQVMEVGNEE

SEQ ID NO: 103 - DNA, 2555 bp, Homo Sapien
ggggcgggtggacgcggactcgaacgcagttgcttcgggacccaggaccccctcgggcccgacccgccaggaaagactgaggccgcggcctgccccgcccggctccctgcgccgccgccgcctcccgggacagaagatgtgctccagggtccctctgctgctgccgctgctcctgctactggccctggggcctggggtgcagggctgcccatccggctgccagtgcagccagccacagacagtcttctgcactgcccgccaggggaccacggtgccccgagacgtgccacccgacacggtggggctgtacgtctttgagaacggcatcaccatgctcgacgcaagcagctttgccggcctgccgggcctgcagctcctggacctgtcacagaaccagatcgccagcctgcgcctgccccgcctgctgctgctggacctcagccacaacagcctcctggccctggagcccggcatcctggacactgccaacgtggaggcgctgcggctggctggtctggggctgcagcagctggacgaggggctcttcagccgcttgcgcaacctccacgacctggatgtgtccgacaaccagctggagcgagtgccacctgtgatccgaggcctccggggcctgacgcgcctgcggctggccggcaacacccgcattgcccagctgcggcccgaggacctggccggcctggctgccctgcaggagctggatgtgagcaacctaagcctgcaggccctgcctggcgacctctcgggcctcttcccccgcctgcggctgctggcagctgcccgcaaccccttcaactgcgtgtgccccctgagctggtttggcccctgggtgcgcgagagccacgtcacactggccagccctgaggagacgcgctgccacttcccgcccaagaacgctggccggctgctcctggagcttgactacgccgactttggctgcccagccaccaccaccacagccacagtgcccaccacgaggcccgtggtgcgggagcccacagccttgtcttctagcttggctcctacctggcttagccccacagcgccggccactgaggcccccagcccgccctccactgccccaccgactgtagggcctgtcccccagccccaggactgcccaccgtccacctgcctcaatgggggcacatgccacctggggacacggcaccacctggcgtgcttgtgccccgaaggcttcacgggcctgtactgtgagagccagatggggcaggggacacggcccagccctacaccagtcacgccgaggccaccacggtccctgaccctgggcatcgagccggtgagccccacctccctgcgcgtggggctgcagcgctacctccaggggagctccgtgcagctcaggagcctccgtctcacctatcgcaacctatcgggccctgataagcggctggtgacgctgcgactgcctgcctcgctcgctgagtacacggtcacccagctgcggcccaacgccacttactccgtctgtgtcatgcctttggggcccgggcgggtgccggagggcgaggaggcctgcggggaggcccatacacccccagccgtccactccaaccacgccccagtcacccaggcccgcgagggcaacctgccgctcctcattgcgcccgccctggccgcggtgctcctggccgcgctggctgcggtgggggcagcctactgtgtgcggcgggggcgggccatggcagcagcggctcaggacaaagggcaggtggggccaggggctgggcccctggaactggagggagtgaaggtccccttggagccaggcccgaaggcaacagagggcggtggagaggccctgcccagcgggtctgagtgtgaggtgccactcatgggcttcccagggcctggcctccagtcacccctccacgcaaagccctacatctaagccagagagagacagggcagctggggccgggctctcagccagtgagatggccagccccctcctgctgccacaccacgtaagttctcagtcccaacctcggggatgtgtgcagacagggctgtgtgaccacagctgggccctgttccctctggacctcggtctcctcatctgtgagatgctgtggcccagctgacgagccctaacgtccccagaaccgagtgcctatgaggacagtgtccgccctgccctccgcaacgtgcagtccctgggcacggcgggccctgccatgtgctggtaacgcatgcctgggccctgctgggctctcccactccaggcggaccctgggggccagtgaaggaagctcccggaaagagcagagggagagcgggtaggcggctgtgtgactctagtcttggccccaggaagcgaaggaacaaaagaaactggaaaggaagatgctttaggaacatgttttgcttttttaaaatatatatatatttataagagatcctttcccatttattctgggaagatgtttttcaaactcagagacaaggactttggtttttgtaagacaaacgatgatatgaaggccttttgtaagaaaaaataaaaaaaaaaa

SEQ ID NO: 104 - protein, 598 aa, Homo Sapien [sequence omitted]

SEQ ID NO: 105 - DNA, 647 bp, Homo Sapien
cccacgcgtccgaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatctaaaaaaaaaaaaa

SEQ ID NO: 106 - protein, 98 aa, Homo Sapien
MKLMVLVFTIGLTLLLGVQAMPANRLSCYRKILKDHNCHNLPEGVADLTQIDVNVQDHFWDGKGCEMICYCNFSELLCCPKDVFFGPKISFVIPCNNQ

SEQ ID NO: 107 - DNA, 972 bp, Homo Sapien
agtgactgcagccttcctagatcccctccactcggtttctctctttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacgtgacatgcatgacttctttgtgggacttatgggcaagaggagcgtccagccagagggaaagacaggacctttcttaccttcagtgagggttcctcggccccttcatcccaatcagcttggatccacaggaaagtcttccctgggaacagaggagcagagacctttataagactctcctacggatgtgaatcaagagaacgtccccagctttggcatcctcaagtatcccccgagagcagaataggtactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttttgcatatgaaaaaaaaaaaaaaaaaaaaaaaaaaaaaaaaaaaaaaaaaaaa

SEQ ID NO: 108 - protein, 135 aa, Homo Sapien
MRIMLLFTAILAFSLAQSFGAVCKEPQEEVVPGGGRSKRDPDLYQLLQRLFKSHSSLEGLLKALSQASTDPKESTSPEKRDMHDFFVGLMGKRSVQPEGKTGPFLPSVRVPRPLHPNQLGSTGKSSLGTEEQRPL

SEQ ID NO: 109 - DNA, 1485 bp, Homo Sapien
gcggccacacgcagctagccggagcccggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggaggggtcagtgacactatatcctaccgagactttgtgaacatgatgctggggaaacggtcggctgtcctcaagttagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgatatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggttccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggtttggggggaaaggtcagctcagtgctgttccaccttttagggaggatactgaggggaccaggatgggagaatgaggagtaaaatgctcacggcaaagtcagcagcactggtaagccaagactgagaaatacaaggttgcttgtctgaccccaatctgcttgaaaaaaaaaaaaaaaaaa

SEQ ID NO: 110 - protein, 150 aa, Homo Sapien
MSGELSNRFQGGKAFGLLKARQERRLAEINREFLCDQKYSDEENLPEKLTAFKEKYMEFDLNNEGEIDLMSLKRMMEKLGVPKTHLEMKKMISEVTGGVSDTISYRDFVNMMLGKRSAVLKLVMMFEGKANESSPKPVGPPPERDIASLP

SEQ ID NO: 111 - DNA, 537 bp, Homo Sapien
taaaacagctacaatattccagggccagtcacttgccatttctcataacagcgtcagagagaaagaactgactgaaacgtttgagatgaagaaagttctcctcctgatcacagccatcttggcagtggctgttggtttcccagtctctcaagaccaggaacgagaaaaaagaagtatcagtgacagcgatgaattagcttcagggttttttgtgttcccttacccatatccatttcgcccacttccaccaattccatttccaagatttccatggtttagacgtaattttcctattccaatacctgaatctgcccctacaactccccttcctagcgaaaagtaaacaagaaggataagtcacgataaacctggtcacctgaaattgaaattgagccacttccttgaagaatcaaaattcctgttaataaaagaaaaacaaatgtaattgaaatagcacacagcattctctagtcaatatctttagtgatcttctttaataaacatgaaagcaaagattttggtttcttaatttccaca

SEQ ID NO: 112 - protein, 85 aa, Homo Sapien
MKKVLLLITAILAVAVGFPVSQDQEREKRSISDSDELASGFFVFPYPYPFRPLPPIPFPRFPWFRRNFPIPIPESAPTTPLPSEK

SEQ ID NO: 113 - DNA, 1686 bp, Homo Sapien
ctcctcttaacatacttgcagctaaaactaaatattgctgcttggggacctccttctagccttaaatttcagctcatcaccttcacctgccttggtcatggctctgctattctccttgatccttgccatttgcaccagacctggattcctagcgtctccatctggagtgcggctggtggggggcctccaccgctgtgaagggcgggtggaggtggaacagaaaggccagtggggcaccgtgtgtgatgacggctgggacattaaggacgtggctgtgttgtgccgggagctgggctgtggagctgccagcggaacccctagtggtattttgtatgagccaccagcagaaaaagagcaaaaggtcctcatccaatcagtcagttgcacaggaacagaagatacattggctcagtgtgagcaagaagaagtttatgattgttcacatgatgaagatgctggggcatcgtgtgagaacccagagagctctttctccccagtcccagagggtgtcaggctggctgacggccctgggcattgcaagggacgcgtggaagtgaagcaccagaaccagtggtataccgtgtgccagacaggctggagcctccgggccgcaaaggtggtgtgccggcagctgggatgtgggagggctgtactgactcaaaaacgctgcaacaagcatgcctatggccgaaaacccatctggctgagccagatgtcatgctcaggacgagaagcaacccttcaggattgcccttctgggccttgggggaagaacacctgcaaccatgatgaagacacgtgggtcgaatgtgaagatccctttgacttgagactagtaggaggagacaacctctgctctgggcgactggaggtgctgcacaagggcgtatggggctctgtctgtgatgacaactggggagaaaaggaggaccaggtggtatgcaagcaactgggctgtgggaagtccctctctccctccttcagagaccggaaatgctatggccctggggttggccgcatctggctggataatgttcgttgctcaggggaggagcagtccctggagcagtgccagcacagattttgggggtttcacgactgcacccaccaggaagatgtggctgtcatctgctcagtgtaggtgggcatcatctaatctgttgagtgcctgaatagaagaaaaacacagaagaagggagcatttactgtctacatgactgcatgggatgaacactgatcttcttctgcccttggactgggacttatacttggtgcccctgattctcaggccttcagagttggatcagaacttacaacatcaggtctagttctcaggccatcagacatagtttggaactacatcaccacctttcctatgtctccacattgcacacagcagattcccagcctccataattgtgtgtatcaactacttaaatacattctcacacacacacacacacacacacacacacacacacacacatacaccatttgtcctgtttctctgaagaactctgacaaaatacagattttggtactgaaagagattctagaggaacggaattttaaggataaattttctgaattggttatggggtttctgaaattggctctataatctaattagatataaaattctggtaactttatttacaataataaagatagcactatgtgttcaaa

SEQ ID NO: 114 - protein, 347 aa, Homo Sapien
MALLFSLILAICTRPGFLASPSGVRLVGGLHRCEGRVEVEQKGQWGTVCDDGWDIKDVAVLCRELGCGAASGTPSGILYEPPAEKEQKVLIQSVSCTGTEDTLAQCEQEEVYDCSHDEDAGASCENPESSFSPVPEGVRLADGPGHCKGRVEVKHQNQWYTVCQTGWSLRAAKVVCRQLGCGRAVLTQKRCNKHAYGRKPIWLSQMSCSGREATLQDCPSGPWGKNTCNHDEDTWVECEDPFDLRLVGGDNLCSGRLEVLHKGVWGSVCDDNWGEKEDQVVCKQLGCGKSLSPSFRDRKCYGPGVGRIWLDNVRCSGEEQSLEQCQHRFWGFHDCTHQEDVAVICSV

SEQ ID NO: 115 - DNA, 728 bp, Homo Sapien
catttccaacaagagcactggccaagtcagcttcttctgagagagtctctagaagacatgatgctacactcagctttgggtctctgcctcttactcgtcacagtttcttccaaccttgccattgcaataaaaaaggaaaagaggcctcctcagacactctcaagaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctattgatagaaaacatgaagaaagcattaagacttattcagtcagagctataagagatgatggaaaaaagccttcacttcaaagaagtcaaatttcatgaagaaaacctctggcacattgacaaatactaaatgtgcaagtatatagattttgtaatattactatttagtttttttaatgtgtttgcaatagtcttattaaaataaatgttttttaaatctga

SEQ ID NO: 116 - protein, 166 aa, Homo Sapien
MMLHSALGLCLLLVTVSSNLAIAIKKEKRPPQTLSRGWGDDITWVQTYEEGLFYAQKSKKPLMVIHHLEDCQYSQALKKVFAQNEEIQEMAQNKFIMLNLMHETTDKNLSPDGQYVPRIMFVDPSLTVRADIAGRYSNRLYTYEPRDLPLLIENMKKALRLIQSEL

SEQ ID NO: 117 - DNA, 2395 bp, Homo Sapien
cctggagccggaagcgcggctgcagcagggcgaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggcattgatgacggggagccttcctggctttgtcgacgtcatcaggaacctcaattctcctgcactgctggaagacagtgtgataagacaagcaaaagcagctggaaaaagaatagtcttttatggagatgaaacctgggttaaattattcccaaagcattttgtggaatatgatggaacaacctcatttttcgtgtcagattacacagaggtggataataatgtcacgaggcatttggataaagtattaaaaagaggagattgggacatattaatcctccactacctggggctggaccacattggccacatttcagggcccaacagccccctgattgggcagaagctgagcgagatggacagcgtgctgatgaagatccacacctcactgcagtcgaaggagagagagacgcctttacccaatttgctggttctttgtggtgaccatggcatgtctgaaacaggaagtcacggggcctcctccaccgaggaggtgaatacacctctgattttaatcagttctgcgtttgaaaggaaacccggtgatatccgacatccaaagcacgtccaatagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagttctcaccctgctcctgctcagcgtcccacaggcactgcacagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggctgcctttcgtttaccagactctggttgaacacctggtgtgtgccaagtgctggcagtgccctggacagggggcctcagggaaggacgtggagcagccttatcccaggcctctgggtgtcccgacacaggtgttcacatctgtgctgtcaggtcagatgcctcagttcttggaaagctaggttcctgcgactgttaccaaggtgattgtaaagagctggcggtcacagaggaacaagccccccagctgagggggtgtgtgaatcggacagcctcccagcagaggtgtgggagctgcagctgagggaagaagagacaatcggcctggacactcaggagggtcaaaaggagacttggtcgcaccactcatcctgccacccccagaatgcatcctgcctcatcaggtccagatttctttccaaggcggacgttttctgttggaattcttagtccttggcctcggacaccttcattcgttagctggggagtggtggtgaggcagtgaagaagaggcggatggtcacactcagatccacagagcccaggatcaagggacccactgcagtggcagcaggactgttgggcccccaccccaaccctgcacagccctcatcccctcttggcttgagccgtcagaggccctgtgctgagtgtctgaccgagacactcacagctttgtcatcagggcacaggcttcctcggagccaggatgatctgtgccacgcttgcacctcgggcccatctgggctcatgctctctctcctgctattgaattagtacctagctgcacacagtatgtagttaccaaaagaataaacggcaataattgagaaaaaaaa

SEQ ID NO: 118 - protein, 310 aa, Homo Sapien
MRLGSGTFATCCVAIEVLGIAVFLRGFFPAPVRSSARAEHGAEPPAPEPSAGASSNWTTLPPPLFSKVVIVLIDALRDDFVFGSKGVKFMPYTTYLVEKGASHSFVAEAKPPTVTMPRIKALMTGSLPGFVDVIRNLNSPALLEDSVIRQAKAAGKRIVFYGDETWVKLFPKHFVEYDGTTSFFVSDYTEVDNNVTRHLDKVLKRGDWDILILHYLGLDHIGHISGPNSPLIGQKLSEMDSVLMKIHTSLQSKERETPLPNLLVLCGDHGMSETGSHGASSTEEVNTPLILISSAFERKPGDIRHPKHVQ

SEQ ID NO: 119 - DNA, 1333 bp, Homo Sapien
gcccacgcgtccgatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactc

SEQ ID NO: 120 - protein, 144 aa, Homo Sapien
MAFTFAAFCYMLALLLTAALIFFAIWHIIAFDELKTDYKNPIDQCNTLNPLVLPEYLIHAFFCVMFLCAAEWLTLGLNMPLLAYHIWRYMSRPVMSGPGLYDPTTIMNADILAYCQKEGWCKLAFYLLAFFYYLYGMIYVLVSS

SEQ ID NO: 121 - DNA, 1838 bp, Homo Sapien
cggacgcgtgggcggacgcgtgggcggcccacggcgcccgcgggctggggcggtcgcttcttccttctccgtggcctacgagggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaaaaaaaaaaaaaaaaaaaaaa

SEQ ID NO: 122 - protein, 420 aa, Homo Sapien
MAPWPPKGLVPAVLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLDVDECETEVCPGENKQCENTEGGYRCICAEGYKQMEGICVKEQIPESAGFFSEMTEDELVVLQQMFFGIIICALATLAAKGDLVFTAIFIGAVAAMTGYWLSERSDRVLEGFIKGR

SEQ ID NO: 123 - DNA, 3401 bp, Homo Sapien
gcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtacacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcctgcgctggccttcctgcgcgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgcgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgcggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtttttgtggcagttttagttttttgttttttttttttttaatcaaaaaacaattttttttaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccacctcctgcggcatgggtgtgtccagtgccaccgctggcctccgctgcttccatcagccctgtcgccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaacctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaaaaaaaaaaaaaa

SEQ ID NO: 124 - protein, 546 aa, Homo Sapien
MRQTIIKVIKFILIICYTVYYVHNIKFDVDCTVDIESLTGYRTYRCAHPLATLFKILASFYISLVIFYGLICMYTLWWMLRRSLKKYSFESIREESSYSDIPDVKNDFAFMLHLIDQYDPLYSKRFAVFLSEVSENKLRQLNLNNEWTLDKLRQRLTKNAQDKLELHLFMLSGIPDTVFDLVELEVLKLELIPDVTIPPSIAQLTGLKELWLYHTAAKIEAPALAFLRENLRALHIKFTDIKEIPLWIYSLKTLEELHLTGNLSAENNRYIVIDGLRELKRLKVLRLKSNLSKLPQVVTDVGVHLQKLSINNEGTKLIVLNSLKKMANLTELELIRCDLERIPHSIFSLHNLQEIDLKDNNLKTIEEIISFQHLHRLTCLKLWYNHIAYIPIQIGNLTNLERLYLNRNKIEKIPTQLFYCRKLRYLDLSHNNLTFLPADIGLLQNLQNLAITANRIETLPPELFQCRKLRALHLGNNVLQSLPSRVGELTNLTQIELRGNRLECLPVELGECPLLKRSGLVVEEDLFNTLPPEVKERLWRADKEQA

SEQ ID NO: 125 - DNA, 1679 bp, Homo Sapien
gttgtgtccttcagcaaaacagtggatttaaatctccttgcacaagcttgagagcaacacaatctatcaggaaagaaagaaagaaaaaaaccgaacctgacaaaaaagaagaaaaagaagaagaaaaaaaatcatgaaaaccatccagccaaaaatgcacaattctatctcttgggcaatcttcacggggctggctgctctgtgtctcttccaaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcacccgggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaagagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaaaaaaaaa

SEQ ID NO: 126 - protein, 344 aa, Homo Sapien
MKTIQPKMHNSISWAIFTGLAALCLFQGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 127 - DNA, 2236 bp, Homo Sapien
ggcgccggtgcaccgggcgggctgagcgcctcctgcggcccggcctgcgcgccccggcccgccgcgccgcccacgccccaaccccggcccgcgccccctagcccccgcccgggcccgcgcccgcgcccgcgcccaggtgagcgctccgcccgccgcgaggccccgccccggcccgcccccgccccgccccggccggcgggggaaccgggcggattcctcgcgcgtcaaaccacctgatcccataaaacattcatcctcccggcggcccgcgctgcgagcgccccgccagtccgcgccgccgccgccctcgccctgtgcgccctgcgcgccctgcgcacccgcggcccgagcccagccagagccgggcggagcggagcgcgccgagcctcgtcccgcggccgggccggggccgggccgtagcggcggcgcctggatgcggacccggccgcggggagacgggcgcccgccccgaaacgactttcagtccccgacgcgccccgcccaacccctacgatgaagagggcgtccgctggagggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacgctgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcagtacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggacgcgtgccgcccggtgacagcccgccgggcaacggctctggcccacggcacatcaatgactcaccctttgggactctgcctggctctgctgagcccccgctcactgcagtgcggcccgagggctccgagccaccagggttccccacctcgggccctcgccggaggccaggctgttcacgcaagaaccgcacccgcagccactgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttcttaaaaaaa

SEQ ID NO: 128 - protein, 473 aa, Homo Sapien
MKRASAGGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGSGPRHINDSPFGTLPGSAEPPLTAVRPEGSEPPGFPTSGPRRRPGCSRKNRTRSHCRLGQAGSGGGGTGDSEGSGALPSLTCSLTPLGLALVLWTVLGPC

SEQ ID NO: 129 - DNA, 2458 bp, Homo Sapien
gcgccgggagcccatctgcccccaggggcacggggcgcggggccggctcccgcccggcacatggctgcagccacctcgcgcgcaccccgaggcgccgcgcccagctcgcccgaggtccgtcggaggcgcccggccgccccggagccaagcagcaactgagcggggaagcgcccgcgtccggggatcgggatgtccctcctccttctcctcttgctagtttcctactatgttggaaccttggggactcacactgagatcaagagagtggcagaggaaaaggtcactttgccctgccaccatcaactggggcttccagaaaaagacactctggatattgaatggctgctcaccgataatgaagggaaccaaaaagtggtgatcacttactccagtcgtcatgtctacaataacttgactgaggaacagaagggccgagtggcctttgcttccaatttcctggcaggagatgcctccttgcagattgaacctctgaagcccagtgatgagggccggtacacctgtaaggttaagaattcagggcgctacgtgtggagccatgtcatcttaaaagtcttagtgagaccatccaagcccaagtgtgagttggaaggagagctgacagaaggaagtgacctgactttgcagtgtgagtcatcctctggcacagagcccattgtgtattactggcagcgaatccgagagaaagagggagaggatgaacgtctgcctcccaaatctaggattgactacaaccaccctggacgagttctgctgcagaatcttaccatgtcctactctggactgtaccagtgcacagcaggcaacgaagctgggaaggaaagctgtgtggtgcgagtaactgtacagtatgtacaaagcatcggcatggttgcaggagcagtgacaggcatagtggctggagccctgctgattttcctcttggtgtggctgctaatccgaaggaaagacaaagaaagatatgaggaagaagagagacctaatgaaattcgagaagatgctgaagctccaaaagcccgtcttgtgaaacccagctcctcttcctcaggctctcggagctcacgctctggttcttcctccactcgctccacagcaaatagtgcctcacgcagccagcggacactgtcaactgacgcagcaccccagccagggctggccacccaggcatacagcctagtggggccagaggtgagaggttctgaaccaaagaaagtccaccatgctaatctgaccaaagcagaaaccacacccagcatgatccccagccagagcagagccttccaaacggtctgaattacaatggacttgactcccacgctttcctaggagtcagggtctttggactcttctcgtcattggagctcaagtcaccagccacacaaccagatgagaggtcatctaagtagcagtgagcattgcacggaacagattcagatgagcattttccttatacaataccaaacaagcaaaaggatgtaagctgattcatctgtaaaaaggcatcttattgtgcctttagaccagagtaagggaaagcaggagtccaaatctatttgttgaccaggacctgtggtgagaaggttggggaaaggtgaggtgaatatacctaaaacttttaatgtgggatattttgtatcagtgctttgattcacaattttcaagaggaaatgggatgctgtttgtaaattttctatgcatttctgcaaacttattggattattagttattcagacagtcaagcagaacccacagccttattacacctgtctacaccatgtactgagctaaccacttctaagaaactccaaaaaaggaaacatgtgtcttctattctgacttaacttcatttgtcataaggtttggatattaatttcaaggggagttgaaatagtgggagatggagaagagtgaatgagtttctcccactctatactaatctcactatttgtattgagcccaaaataactatgaaaggagacaaaaatttgtgacaaaggattgtgaagagctttccatcttcatgatgttatgaggattgttgacaaacattagaaatatataatggagcaattgtggatttcccctcaaatcagatgcctctaaggactttcctgctagatatttctggaaggagaaaatacaacatgtcatttatcaacgtccttagaaagaattcttctagagaaaaagggatctaggaatgctgaaagattacccaacataccattatagtctcttctttctgagaaaatgtgaaaccagaattgcaagactgggtggactagaaagggagattagatcagttttctcttaatatgtcaaggaaggtagccgggcatggtgccaggcacctgtaggaaaatccagcaggtggaggttgcagtgagccgagattatgccattgcactccagcctgggtgacagagcgggactccgtctc

SEQ ID NO: 130 - protein, 373 aa, Homo Sapien
MSLLLLLLLVSYYVGTLGTHTEIKRVAEEKVTLPCHHQLGLPEKDTLDIEWLLTDNEGNQKVVITYSSRHVYNNLTEEQKGRVAFASNFLAGDASLQIEPLKPSDEGRYTCKVKNSGRYVWSHVILKVLVRPSKPKCELEGELTEGSDLTLQCESSSGTEPIVYYWQRIREKEGEDERLPPKSRIDYNHPGRVLLQNLTMSYSGLYQCTAGNEAGKESCVVRVTVQYVQSIGMVAGAVTGIVAGALLIFLLVWLLIRRKDKERYEEEERPNEIREDAEAPKARLVKPSSSSSGSRSSRSGSSSTRSTANSASRSQRTLSTDAAPQPGLATQAYSLVGPEVRGSEPKKVHHANLTKAETTPSMIPSQSRAFQTV

SEQ ID NO: 131 - DNA, 2738 bp, Homo Sapien
ggaagtccacggggagcttggatgccaaagggaggacggctgggtcctctggagaggactactcactggcatatttctgaggtatctgtagaataaccacagcctcagatactggggactttacagtcccacagaaccgtcctcccaggaagctgaatccagcaagaacaatggaggccagcgggaagctcatttgcagacaaaggcaagtccttttttcctttctccttttgggcttatctctggcgggcgcggcggaacctagaagctattctgtggtggaggaaactgagggcagctcctttgtcaccaatttagcaaaggacctgggtctggagcagagggaattctccaggcggggggttagggttgtttccagagggaacaaactacatttgcagctcaatcaggagaccgcggatttgttgctaaatgagaaattggaccgtgaggatctgtgcggtcacacagagccctgtgtgctacgtttccaagtgttgctagagagtcccttcgagttttttcaagctgagctgcaagtaatagacataaacgaccactctccagtatttctggacaaacaaatgttggtgaaagtatcagagagcagtcctcctgggactacgtttcctctgaagaatgccgaagacttagatgtaggccaaaacaatattgagaactatataatcagccccaactcctattttcgggtcctcacccgcaaacgcagtgatggcaggaaatacccagagctggtgctggacaaagcgctggaccgagaggaagaagctgagctcaggttaacactcacagcactggatggtggctctccgcccagatctggcactgctcaggtctacatcgaagtcctggatgtcaacgataatgcccctgaatttgagcagcctttctatagagtgcagatctctgaggacagtccggtaggcttcctggttgtgaaggtctctgccacggatgtagacacaggagtcaacggagagatttcctattcacttttccaagcttcagaagagattggcaaaacctttaagatcaatcccttgacaggagaaattgaactaaaaaaacaactcgatttcgaaaaacttcagtcctatgaagtcaatattgaggcaagagatgctggaaccttttctggaaaatgcaccgttctgattcaagtgatagatgtgaacgaccatgccccagaagttaccatgtctgcatttaccagcccaatacctgagaacgcgcctgaaactgtggttgcacttttcagtgtttcagatcttgattcaggagaaaatgggaaaattagttgctccattcaggaggatctacccttcctcctgaaatccgcggaaaacttttacaccctactaacggagagaccactagacagagaaagcagagcggaatacaacatcactatcactgtcactgacttggggacccctatgctgataacacagctcaatatgaccgtgctgatcgccgatgtcaatgacaacgctcccgccttcacccaaacctcctacaccctgttcgtccgcgagaacaacagccccgccctgcacatccgcagcgtcagcgctacagacagagactcaggcaccaacgcccaggtcacctactcgctgctgccgccccaggacccgcacctgcccctcacatccctggtctccatcaacgcggacaacggccacctgttcgccctcaggtctctggactacgaggccctgcaggggttccagttccgcgtgggcgcttcagaccacggctccccggcgctgagcagcgaggcgctggtgcgcgtggtggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagctcggtctgttcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccgacccaggcccaggccgacttgctcaccgtctacctggtggtggcgttggcctcggtgtcttcgctcttcctcttttcggtgctcctgttcgtggcggtgcggctgtgtaggaggagcagggcggcctcggtgggtcgctgcttggtgcccgagggcccccttccagggcatcttgtggacatgagcggcaccaggaccctatcccagagctaccagtatgaggtgtgtctggcaggaggctcagggaccaatgagttcaagttcctgaagccgattatccccaacttccctccccagtgccctgggaaagaaatacaaggaaattctaccttccccaataactttgggttcaatattcagtgaccatagttgacttttacattccataggtattttattttgtggcatttccatgccaatgtttatttcccccaatttgtgtgtatgtaatattgtacggatttactcttgatttttctcatgttctttctccctttgttttaaagtgaacatttacctttattcctggttctt

SEQ ID NO: 132 - protein, 798 aa, Homo Sapien
MEASGKLICRQRQVLFSFLLLGLSLAGAAEPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTTFPLKNAEDLDVGQNNIENYIISPNSYFRVLTRKRSDGRKYPELVLDKALDREEEAELRLTLTALDGGSPPRSGTAQVYIEVLDVNDNAPEFEQPFYRVQISEDSPVGFLVVKVSATDVDTGVNGEISYSLFQASEEIGKTFKINPLTGEIELKKQLDFEKLQSYEVNIEARDAGTFSGKCTVLIQVIDVNDHAPEVTMSAFTSPIPENAPETVVALFSVSDLDSGENGKISCSIQEDLPFLLKSAENFYTLLTERPLDRESRAEYNITITVTDLGTPMLITQLNMTVLIADVNDNAPAFTQTSYTLFVRENNSPALHIRSVSATDRDSGTNAQVTYSLLPPQDPHLPLTSLVSINADNGHLFALRSLDYEALQGFQFRVGASDHGSPALSSEALVRVVVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPTQAQADLLTVYLVVALASVSSLFLFSVLLFVAVRLCRRSRAASVGRCLVPEGPLPGHLVDMSGTRTLSQSYQYEVCLAGGSGTNEFKFLKPIIPNFPPQCPGKEIQGNSTFPNNFGFNIQ

SEQ ID NO: 133 - DNA, 3819 bp, Homo Sapien
ggaaggggaggagcaggccacacaggcacaggccggtgagggacctgcccagacctggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagccaggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcgcctagcaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 134 - protein, 693 aa, Homo Sapien
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRVPLPCRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 135 - DNA, 1615 bp, Homo Sapien
gcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaaaaaaaaaaa

SEQ ID NO: 136 - protein, 437 aa, Homo Sapien
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPDIQLVHHSAIQKSTKELRDMSKNREIAWPLSTLPVFHPVTGEIIPPLHTDNYDSTNMPLMQTQQNLPHQTQIPQQQTTGKWYP

SEQ ID NO: 137 - DNA, 1621 bp, Homo Sapien
cagaagagggggctagctagctgtctctgcggaccagggagacccccgcgcccccccggtgtgaggcggcctcacagggccgggtgggctggcgagccgacgcggcggcggaggaggctgtgaggagtgtgtggaacaggacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttattttta

SEQ ID NO: 138 - protein, 358 aa, Homo Sapien
MAPQNLSTFCLLLLYLIGAVIAGRDFYKILGVPRSASIKDIKKAYRKLALQLHPDRNPDDPQAQEKFQDLGAAYEVLSDSEKRKQYDTYGEEGLKDGHQSSHGDIFSHFFGDFGFMFGGTPRQQDRNIPRGSDIIVDLEVTLEEVYAGNFVEVVRNKPVARQAPGKRKCNCRQEMRTTQLGPGRFQMTQEVVCDECPNVKLVNEERTLEVEIEPGVRDGMEYPFIGEGEPHVDGEPGDLRFRIKVVKHPIFERRGDDLYTNVTISLVESLVGFEMDITHLDGHKVHISRDKITRPGAKLWKKGEGLPNFDNNNIKGSLIITFDVDFPKEQLTEEAREGIKQLLKQGSVQKVYNGLQGY

SEQ ID NO: 139 - DNA, 550 bp, Homo Sapien
ccagtctgtcgccacctcacttggtgtctgctgtccccgccaggcaagcctggggtgagagcacagaggagtgggccgggaccatgcgggggacgcggctggcgctcctggcgctggtgctggctgcctgcggagagctggcgccggccctgcgctgctacgtctgtccggagcccacaggagtgtcggactgtgtcaccatcgccacctgcaccaccaacgaaaccatgtgcaagaccacactctactcccgggagatagtgtaccccttccagggggactccacggtgaccaagtcctgtgccagcaagtgtaagccctcggatgtggatggcatcggccagaccctgcccgtgtcctgctgcaatactgagctgtgcaatgtagacggggcgcccgctctgaacagcctccactgcggggccctcacgctcctcccactcttgagcctccgactgtagagtccccgcccacccccatggccctatgcggcccagccccgaatgccttgaagaagtgccccctgcaccaggaaaaaaaaaaaaaaaaa

SEQ ID NO: 140 - protein, 125 aa, Homo Sapien
MRGTRLALLALVLAACGELAPALRCYVCPEPTGVSDCVTIATCTTNETMCKTTLYSREIVYPFQGDSTVTKSCASKCKPSDVDGIGQTLPVSCCNTELCNVDGAPALNSLHCGALTLLPLLSLRL

SEQ ID NO: 141 - DNA, 1524 bp, Homo Sapien
ggcgccgcgtaggcccgggaggccgggccggccgggctgcgagcgcctgccccatgcgccgccgcctctccgcacgatgttcccctcgcggaggaaagcggcgcagctgccctgggaggacggcaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgtgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggttcaaccgggcagcgctcatcaacgtgggcttcctggagagcagcaacagcacggactacattgccatgcacgacgttgacctgctccctctcaacgaggagctggactatggctttcctgaggctgggcccttccacgtggcctccccggagctccaccctctctaccactacaagacctatgtcggcggcatcctgctgctctccaagcagcactaccggctgtgcaatgggatgtccaaccgcttctggggctggggccgcgaggacgacgagttctaccggcgcattaagggagctgggctccagcttttccgcccctcgggaatcacaactgggtacaagacatttcgccacctgcatgacccagcctggcggaagagggaccagaagcgcatcgcagctcaaaaacaggagcagttcaaggtggacagggagggaggcctgaacactgtgaagtaccatgtggcttcccgcactgccctgtctgtgggcggggccccctgcactgtcctcaacatcatgttggactgtgacaagaccgccacaccctggtgcacattcagctgagctggatggacagtgaggaagcctgtacctacaggccatattgctcaggctcaggacaaggcctcaggtcgtgggcccagctctgacaggatgtggagtggccaggaccaagacagcaagctacgcaattgcagccacccggccgccaaggcaggcttgggctgggccaggacacgtggggtgcctgggacgctgcttgccatgcacagtgatcagagagaggctggggtgtgtcctgtccgggaccccccctgccttcctgctcaccctactctgacctccttcacgtgcccaggcctgtgggtagtggggagggctgaacaggacaacctctcatcaccctactctgacctccttcacgtgcccaggcctgtgggtagtggggagggctgaacaggacaacctctcatcacccccaaaaaaaaaaaaaaaaaaaaaaaaaaaaaaaaaaaaaaaaaaaaaaa

SEQ ID NO: 142 - protein, 327 aa, Homo Sapien
MFPSRRKAAQLPWEDGRSGLLSGGLPRKCSVFHLFVACLSLGFFSLLWLQLSCSGDVARAVRGQGQETSGPPRACPPEPPPEHWEEDASWGPHRLAVLVPFRERFEELLVFVPHMRRFLSRKKIRHHIYVLNQVDHFRFNRAALINVGFLESSNSTDYIAMHDVDLLPLNEELDYGFPEAGPFHVASPELHPLYHYKTYVGGILLLSKQHYRLCNGMSNRFWGWGREDDEFYRRIKGAGLQLFRPSGITTGYKTFRHLHDPAWRKRDQKRIAAQKQEQFKVDREGGLNTVKYHVASRTALSVGGAPCTVLNIMLDCDKTATPWCTFS

SEQ ID NO: 143 - DNA, 1621 bp, Homo Sapien
gtgggatttatttgagtgcaagatcgttttctcagtggtggtggaagttgcctcatcgcaggcagatgttggggctttgtccgaacagctcccctctgccagcttctgtagataagggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcatgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttc

SEQ ID NO: 144 - protein, 371 aa, Homo Sapien
MSFRKVNIIILVLAVALFLLVLHHNFLSLSSLLRNEVTDSGIVGPQPIDFVPNALRHAVDGRQEEIPVVIAASEDRLGGAIAAINSIQHNTRSNVIFYIVTLNNTADHLRSWLNSDSLKSIRYKIVNFDPKLLEGKVKEDPDQGESMKPLTFARFYLPILVPSAKKAIYMDDDVIVQGDILALYNTALKPGHAAAFSEDCDSASTKVVIRGAGNQYNYIGYLDYKKERIRKLSMKASTCSFNPGVFVANLTEWKRQNITNQLEKWMKLNVEEGLYSRTLAGSITTPPLLIVFYQQHSTIDPMWNVRHLGSSAGKRYSPQFVKAAKLLHWNGHLKPWGRTASYTDVWEKWYIPDPTGKFNLIRRYTEISNIK

SEQ ID NO: 145 - DNA, 415 bp, Homo Sapien
aaacttgacgccatgaagatcccggtccttcctgccgtggtgctcctctccctcctggtgctccactctgcccagggagccaccctgggtggtcctgaggaagaaagcaccattgagaattatgcgtcacgacccgaggcctttaacaccccgttcctgaacatcgacaaattgcgatctgcgtttaaggctgatgagttcctgaactggcacgccctctttgagtctatcaaaaggaaacttcctttcctcaactgggatgcctttcctaagctgaaaggactgaggagcgcaactcctgatgcccagtgaccatgacctccactggaagagggggctagcgtgagcgctgattctcaacctaccataactctttcctgcctcaggaactccaataaaacattttccatccaaa

SEQ ID NO: 146 - protein, 99 aa, Homo Sapien
MKIPVLPAVVLLSLLVLHSAQGATLGGPEEESTIENYASRPEAFNTPFLNIDKLRSAFKADEFLNWHALFESIKRKLPFLNWDAFPKLKGLRSATPDAQ

SEQ ID NO: 147 - DNA, 745 bp, Homo Sapien
cctctgtccactgctttcgtgaagacaagatgaagttcacaattgtctttgctggacttcttggagtctttctagctcctgccctagctaactataatatcaacgtcaatgatgacaacaacaatgctggaagtgggcagcagtcagtgagtgtcaacaatgaacacaatgtggccaatgttgacaataacaacggatgggactcctggaattccatctgggattatggaaatggctttgctgcaaccagactctttcaaaagaagacatgcattgtgcacaaaatgaacaaggaagtcatgccctccattcaatcccttgatgcactggtcaaggaaaagaagcttcagggtaagggaccaggaggaccacctcccaagggcctgatgtactcagtcaacccaaacaaagtcgatgacctgagcaagttcggaaaaaacattgcaaacatgtgtcgtgggattccaacatacatggctgaggagatgcaagaggcaagcctgtttttttactcaggaacgtgctacacgaccagtgtactatggattgtggacatttccttctgtggagacacggtggagaactaaacaattttttaaagccactatggatttagtcatctgaatatgctgtgcagaaaaaatatgggctccagtggtttttaccatgtcattctgaaatttttctctactagttatgtttgatttctttaagtttcaataaaatcatttagcattgaaaaaaa

SEQ ID NO: 148 - protein, 185 aa, Homo Sapien
MKFTIVFAGLLGVFLAPALANYNINVNDDNNNAGSGQQSVSVNNEHNVANVDNNNGWDSWNSIWDYGNGFAATRLFQKKTCIVHKMNKEVMPSIQSLDALVKEKKLQGKGPGGPPPKGLMYSVNPNKVDDLSKFGKNIANMCRGIPTYMAEEMQEASLFFYSGTCYTTSVLWIVDISFCGDTVEN

SEQ ID NO: 149 - DNA, 992 bp, Homo Sapien
ggcacgagccaggaactaggaggttctcactgcccgagcagaggccctacacccaccgaggcatggggctccctgggctgttctgcttggccgtgctggctgccagcagcttctccaaggcacgggaggaagaaattacccctgtggtctccattgcctacaaagtcctggaagttttccccaaaggccgctgggtgctcataacctgctgtgcaccccagccaccaccgcccatcacctattccctctgtggaaccaagaacatcaaggtggccaagaaggtggtgaagacccacgagccggcctccttcaacctcaacgtcacactcaagtccagtccagacctgctcacctacttctgccgggcgtcctccacctcaggtgcccatgtggacagtgccaggctacagatgcactgggagctgtggtccaagccagtgtctgagctgcgggccaacttcactctgcaggacagaggggcaggccccagggtggagatgatctgccaggcgtcctcgggcagcccacctatcaccaacagcctgatcgggaaggatgggcaggtccacctgcagcagagaccatgccacaggcagcctgccaacttctccttcctgccgagccagacatcggactggttctggtgccaggctgcaaacaacgccaatgtccagcacagcgccctcacagtggtgcccccaggtggtgaccagaagatggaggactggcagggtcccctggagagccccatccttgccttgccgctctacaggagcacccgccgtctgagtgaagaggagtttggggggttcaggatagggaatggggaggtcagaggacgcaaagcagcagccatgtagaatgaaccgtccagagagccaagcacggcagaggactgcaggccatcagcgtgcactgttcgtatttggagttcatgcaaaatgagtgtgttttagctgctcttgccacaaaaaaaaaaaaaaaaaaaaaaa

SEQ ID NO: 150 - protein, 265 aa, Homo Sapien [sequence omitted]

SEQ ID NO: 151 - DNA, 683 bp, Homo Sapien
gcgtggggatgtctaggagctcgaaggtggtgctgggcctctcggtgctgctgacggcggccacagtggccggcgtacatgtgaagcagcagtgggaccagcagaggcttcgtgacggagttatcagagacattgagaggcaaattcggaaaaaagaaaacattcgtcttttgggagaacagattattttgactgagcaacttgaagcagaaagagagaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaagtggagggagagacgctcctgatcgtcgaatcc

SEQ ID NO: 152 - protein, 81 aa, Homo Sapien
MSRSSKVVLGLSVLLTAATVAGVHVKQQWDQQRLRDGVIRDIERQIRKKENIRLLGEQIILTEQLEAEREKMLLAKGSQKS

SEQ ID NO: 153 - DNA, 1869 bp, Homo Sapien
aatgtgagaggggctgatggaagctgataggcaggactggagtgttagcaccagtactggatgtgacagcaggcagaggagcacttagcagcttattcagtgtccgattctgattccggcaaggatccaagcatggaatgctgccgtcgggcaactcctggcacactgctcctctttctggctttcctgctcctgagttccaggaccgcacgctccgaggaggaccgggacggcctatgggatgcctggggcccatggagtgaatgctcacgcacctgcgggggaggggcctcctactctctgaggcgctgcctgagcagcaagagctgtgaaggaagaaatatccgatacagaacatgcagtaatgtggactgcccaccagaagcaggtgatttccgagctcagcaatgctcagctcataatgatgtcaagcaccatggccagttttatgaatggcttcctgtgtctaatgaccctgacaacccatgttcactcaagtgccaagccaaaggaacaaccctggttgttgaactagcacctaaggtcttagatggtacgcgttgctatacagaatctttggatatgtgcatcagtggtttatgccaaattgttggctgcgatcaccagctgggaagcaccgtcaaggaagataactgtggggtctgcaacggagatgggtccacctgccggctggtccgagggcagtataaatcccagctctccgcaaccaaatcggatgatactgtggttgcacttccctatggaagtagacatattcgccttgtcttaaaaggtcctgatcacttatatctggaaaccaaaaccctccaggggactaaaggtgaaaacagtctcagctccacaggaactttccttgtggacaattctagtgtggacttccagaaatttccagacaaagagatactgagaatggctggaccactcacagcagatttcattgtcaagattcgtaactcgggctccgctgacagtacagtccagttcatcttctatcaacccatcatccaccgatggagggagacggatttctttccttgctcagcaacctgtggaggaggttatcagctgacatcggctgagtgctacgatctgaggagcaaccgtgtggttgctgaccaatactgtcactattacccagagaacatcaaacccaaacccaagcttcaggagtgcaacttggatccttgtccagccagtgacggatacaagcagatcatgccttatgacctctaccatccccttcctcggtgggaggccaccccatggaccgcgtgctcctcctcgtgtggggggggcatccagagccgggcagtttcctgtgtggaggaggacatccaggggcatgtcacttcagtggaagagtggaaatgcatgtacacccctaagatgcccatcgcgcagccctgcaacatttttgactgccctaaatggctggcacaggagtggtctccgtgcacagtgacatgtggccagggcctcagataccgtgtggtcctctgcatcgaccatcgaggaatgcacacaggaggctgtagcccaaaaacaaagccccacataaaagaggaatgcatcgtacccactccctgctataaacccaaagagaaacttccagtcgaggccaagttgccatggttcaaacaagctcaagagctagaagaaggagctgctgtgtcagaggagccctcgtaagttgtaaaagcacagactgttctatatttgaaactgttttgtttaaagaaagcagtgtctcactggttgtagctttcatgggttctgaactaagtgtaatcatctcaccaaagctttttggctctcaaattaaagattgattagtttcaaaaaaaaaaa

SEQ ID NO: 154 - protein, 525 aa, Homo Sapien [sequence omitted]

SEQ ID NO: 155 - DNA, 1734 bp, Homo Sapien
gtggactctgagaagcccaggcagttgaggacaggagagagaaggctgcagacccagagggagggaggacagggagtcggaaggaggaggacagaggagggcacagagacgcagagcaagggcggcaaggaggagaccctggtgggaggaagacactctggagagagagggggctgggcagagatgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgcagcagatgctttgggcaacagggtcggggaagcagcccatgctctgggaaacactgggcacgagattggcagacaggcagaagatgtcattcgacacggagcagatgctgtccgcggctcctggcagggggtgcctggccacagtggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatcgggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgccccacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 156 - protein, 440 aa, Homo Sapien
MKFQGPLACLLLALCLGSGEAGPLQSGEESTGTNIGEALGHGLGDALSEGVGKAIGKEAGGAAGSKVSEALGQGTREAVGTGVRQVPGFGAADALGNRVGEAAHALGNTGHEIGRQAEDVIRHGADAVRGSWQGVPGHSGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGSSSGGSSGGSSGGSSGNSGGSRGDSGSESSWGSSTGSSSGNHGGSGGGNGHKPGCEKPGNEARGSGESGIQGFRGQGVSSNMREISKEGNRLLGGSGDNYRGQGSSWGSGGGDAVGGVNTVNSETSPGMFNFDTFWKNFKSKLGFINWDAINKDQRSSRIP

SEQ ID NO: 157 - DNA, 4104 bp, Homo Sapien
cccacgcgtccgcccacgcgtccgcccacgcgtccgcccacgcgtccgcccacgcgtccgcccacgcgtccgcccacgcgtccggtgcaagctcgcgccgcacactgcctggtggagggaaggagcccgggcgcctctcgccgctccccgcgccgccgtccgcacctccccaccgcccgccgcccgccgcccgccgcccgcaaagcatgagtgagcccgctctctgcagctgcccggggcgcgaatggcaggctgtttccgcggagtaaaaggtggcgccggtcagtggtcgtttccaatgacggacattaaccagactgtcagatcctggggagtcgcgagccccgagtttggagttttttccccccacaacgtcacagtccgaactgcagagggaaaggaaggcggcaggaaggcgaagctcgggctccggcacgtagttgggaaacttgcgggtcctagaagtcgcctccccgccttgccggccgcccttgcagccccgagccgagcagcaaagtgagacattgtgcgcctgccagatccgccggccgcggaccggggctgcctcggaaacacagaggggtcttctctcgccctgcatataattagcctgcacacaaagggagcagctgaatggaggttgtcactctctggaaaaggatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgcctttcagaaactgcgccgagttaaggaactcacgctgagttccaaccagatcacccaactgcccaacaccaccttccggcccatgcccaacctgcgcagcgtggacctctcgtacaacaagctgcaggcgctcgcgcccgacctcttccacgggctgcggaagctcaccacgctgcatatgcgggccaacgccatccagtttgtgcccgtgcgcatcttccaggactgccgcagcctcaagtttctcgacatcggatacaatcagctcaagagtctggcgcgcaactctttcgccggcttgtttaagctcaccgagctgcacctcgagcacaacgacttggtcaaggtgaacttcgcccacttcccgcgcctcatctccctgcactcgctctgcctgcggaggaacaaggtggccattgtggtcagctcgctggactgggtttggaacctggagaaaatggacttgtcgggcaacgagatcgagtacatggagccccatgtgttcgagaccgtgccgcacctgcagtccctgcagctggactccaaccgcctcacctacatcgagccccggatcctcaactcttggaagtccctgacaagcatcaccctggccgggaacctgtgggattgcgggcgcaacgtgtgtgccctagcctcgtggctcagcaacttccaggggcgctacgatggcaacttgcagtgcgccagcccggagtacgcacagggcgaggacgtcctggacgccgtgtacgccttccacctgtgcgaggatggggccgagcccaccagcggccacctgctctcggccgtcaccaaccgcagtgatctggggccccctgccagctcggccaccacgctcgcggacggcggggaggggcagcacgacggcacattcgagcctgccaccgtggctcttccaggcggcgagcacgccgagaacgccgtgcagatccacaaggtggtcacgggcaccatggccctcatcttctccttcctcatcgtggtcctggtgctctacgtgtcctggaagtgtttcccagccagcctcaggcagctcagacagtgctttgtcacgcagcgcaggaagcaaaagcagaaacagaccatgcatcagatggctgccatgtctgcccaggaatactacgttgattacaaaccgaaccacattgagggagccctggtgatcatcaacgagtatggctcgtgtacctgccaccagcagcccgcgagggaatgcgaggtgtgattgtcccagtggctctcaacccatgcgctaccaaatacgcctgggcagccgggacgggccggcgggcaccaggctggggtctccttgtctgtgctctgatatgctccttgactgaaactttaaggggatctctcccagagacttgacattttagctttattgtgtcttaaaaacaaaagcgaattaaaacacaacaaaaaaccccaccccacaaccttcaggacagtctatcttaaatttcatatgagaactccttcctccctttgaagatctgtccatattcaggaatctgagagtgtaaaaaaggtggccataagacagagagagaataatcgtgctttgttttatgctactcctcccaccctgcccatgattaaacatcatgtatgtagaagatcttaagtccatacgcatttcatgaagaaccattggaaagaggaatctgcaatctgggagcttaagagcaaatgatgaccatagaaagctatgttcttactttgtgtgtgtgtctgtatgtttctgcgttgtgtgtctttgtaggcaagcaaacgttgtctacacaaacgggaatttagctcacatcatttcatgcccctgtgcctctagctctggagattggtggggggaggtggggggaaacggcaggaataagggaaagtggtagttttaactaaggttttgtaacacttgaaatcttttctttctcaaattaattatctttaagcttcaagaaacttgctctgacccctctaagcaaactactaagcatttaaaagagaatctaatttttaaaggtgtagcacctttttttttattcttcccacagagggtgctaatctcattatgctgtgctatctgaaaagaacttaaggccacaattcacgtctcgtcctgggcattgtgatggattgaccctccatttgcagtaccttcccagctgattaaagttcagcagtggtattgaggtttttcgaatatttatatagaaaaaaagtcttttcacatgacaaatgacactctcacaccagtcttagccctagtagttttttaggttggaccagaggaagcaggttaaatgagacctgtcctctgctgcactcagaaaaaataggcagtccctgatgctcagatcttagccttgatattaatagttgagaccacctacccacaatgcagcctatactcccaagactacaaagttaccatcgcaaaggaaaggttattccagtaaaaggaaatagttttctcaaccatttaaaaatattcttctgaactcatcaaagtagaagagcccccaaccttttctctctgccttcaagaaggcagacatttggtatgatttagcatcaacaacacatttatgagtatatgtaagtaatcagaggggcaaatgccacttgttattcctcccaagttttccaagcaagtacacacagatctctggtaggattaggggccacttgtgtttccggcttattttagtcgacttgtcagcaagtttgatgcctagtctatctgacatggcccagtagaacagggcattgatggatcacatgagatggtagaaggaacatcatcacatacccctctcacagagaaaattatcaaagaaccagaaattatatctgttttggagcaagagtgtcataatgtttcagggtagtcaaaataaacataaattatctcctctagatgagtggcgatgttggctgatttgggtctgccattgacagaatgtcaaataaaaaggaattagctagaatatgaccattaaatgtgcttctgaaatatattttgagataggtttagaatgtca

SEQ ID NO: 158 - protein, 522 aa, Homo Sapien
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAFQKLRRVKELTLSSNQITQLPNTTFRPMPNLRSVDLSYNKLQALAPDLFHGLRKLTTLHMRANAIQFVPVRIFQDCRSLKFLDIGYNQLKSLARNSFAGLFKLTELHLEHNDLVKVNFAHFPRLISLHSLCLRRNKVAIVVSSLDWVWNLEKMDLSGNEIEYMEPHVFETVPHLQSLQLDSNRLTYIEPRILNSWKSLTSITLAGNLWDCGRNVCALASWLSNFQGRYDGNLQCASPEYAQGEDVLDAVYAFHLCEDGAEPTSGHLLSAVTNRSDLGPPASSATTLADGGEGQHDGTFEPATVALPGGEHAENAVQIHKVVTGTMALIFSFLIVVLVLYVSWKCFPASLRQLRQCFVTQRRKQKQKQTMHQMAAMSAQEYYVDYKPNHIEGALVIINEYGSCTCHQQPARECEV

SEQ ID NO: 159 - DNA, 1049 bp, Homo Sapien
cagagaggaggctttgggaattgtccagcagaaacagagaagtctgaggtggtgtcaagacaaaagatgcttcagctttggaaacttgttctcctgtgcggcgtgctcactgggacctcagagtctcttcttgacaatcttggcaatgacctaagcaatgtcgtggataagctggaacctgttcttcacgagggacttgagacagttgacaatactcttaaaggcatccttgagaaactgaaggtcgacctaggagtgcttcagaaatccagtgcttggcaactggccaagcagaaggcccaggaagctgagaaattgctgaacaatgtcatttctaagctgcttccaactaacacggacatttttgggttgaaaatcagcaactccctcatcctggatgtcaaagctgaaccgatcgatgatggcaaaggccttaacctgagcttccctgtcaccgcgaatgtcactgtggccgggcccatcattggccagattatcaacctgaaagcctccttggacctcctgaccgcagtcacaattgaaactgatccccagacacaccagcctgttgccgtcctgggagaatgcgccagtgacccaaccagcatctcactttccttgctggacaaacacagccaaatcatcaacaagttcgtgaatagcgtgatcaacacgctgaaaagcactgtatcctccctgctgcagaaggagatatgtccactgatccgcatcttcatccactccctggatgtgaatgtcattcagcaggtcgtcgataatcctcagcacaaaacccagctgcaaaccctcatctgaagaggacgaatgaggaggaccactgtggtgcatgctgattggttcccagtggcttgccccacccccttatagcatctccctccaggaagctgctgccaccacctaaccagcgtgaaagcctgagtcccaccagaaggaccttcccagataccccttctcctcacagtcagaacagcagcctctacacatgttgtcctgcccctggcaataaaggcccatttctgcacccttaa

SEQ ID NO: 160 - protein, 249 aa, Homo Sapien
MLQLWKLVLLCGVLTGTSESLLDNLGNDLSNVVDKLEPVLHEGLETVDNTLKGILEKLKVDLGVLQKSSAWQLAKQKAQEAEKLLNNVISKLLPTNTDIFGLKISNSLILDVKAEPIDDGKGLNLSFPVTANVTVAGPIIGQIINLKASLDLLTAVTIETDPQTHQPVAVLGECASDPTSISLSLLDKHSQIINKFVNSVINTLKSTVSSLLQKEICPLIRIFIHSLDVNVIQQVVDNPQHKTQLQTLI

SEQ ID NO: 161 - DNA, 1587 bp, Homo Sapien
cagccacagacgggtcatgagcgcggtattactgctggccctcctggggttcatcctcccactgccaggagtgcaggcgctgctctgccagtttgggacagttcagcatgtgtggaaggtgtccgacctaccccggcaatggacccctaagaacaccagctgcgacagcggcttggggtgccaggacacgttgatgctcattgagagcggaccccaagtgagcctggtgctctccaagggctgcacggaggccaaggaccaggagccccgcgtcactgagcaccggatgggccccggcctctccctgatctcctacaccttcgtgtgccgccaggaggacttctgcaacaacctcgttaactccctcccgctttgggccccacagcccccagcagacccaggatccttgaggtgcccagtctgcttgtctatggaaggctgtctggaggggacaacagaagagatctgccccaaggggaccacacactgttatgatggcctcctcaggctcaggggaggaggcatcttctccaatctgagagtccagggatgcatgccccagccaggttgcaacctgctcaatgggacacaggaaattgggcccgtgggtatgactgagaactgcaataggaaagattttctgacctgtcatcgggggaccaccattatgacacacggaaacttggctcaagaacccactgattggaccacatcgaataccgagatgtgcgaggtggggcaggtgtgtcaggagacgctgctgctcatagatgtaggactcacatcaaccctggtggggacaaaaggctgcagcactgttggggctcaaaattcccagaagaccaccatccactcagcccctcctggggtgcttgtggcctcctatacccacttctgctcctcggacctgtgcaatagtgccagcagcagcagcgttctgctgaactccctccctcctcaagctgcccctgtcccaggagaccggcagtgtcctacctgtgtgcagccccttggaacctgttcaagtggctccccccgaatgacctgccccaggggcgccactcattgttatgatgggtacattcatctctcaggaggtgggctgtccaccaaaatgagcattcagggctgcgtggcccaaccttccagcttcttgttgaaccacaccagacaaatcgggatcttctctgcgcgtgagaagcgtgatgtgcagcctcctgcctctcagcatgagggaggtggggctgagggcctggagtctctcacttggggggtggggctggcactggccccagcgctgtggtggggagtggtttgcccttcctgctaactctattacccccacgattcttcaccgctgctgaccacccacactcaacctccctctgacctcataacctaatggccttggacaccagattctttcccattctgtccatgaatcatcttccccacacacaatcattcatatctactcacctaacagcaacactggggagagcctggagcatccggacttgccctatgggagaggggacgctggaggagtggctgcatgtatctgataatacagaccctgtcctttca

SEQ ID NO: 162 - protein, 437 aa, Homo Sapien
MSAVLLLALLGFILPLPGVQALLCQFGTVQHVWKVSDLPRQWTPKNTSCDSGLGCQDTLMLIESGPQVSLVLSKGCTEAKDQEPRVTEHRMGPGLSLISYTFVCRQEDFCNNLVNSLPLWAPQPPADPGSLRCPVCLSMEGCLEGTTEEICPKGTTHCYDGLLRLRGGGIFSNLRVQGCMPQPGCNLLNGTQEIGPVGMTENCNRKDFLTCHRGTTIMTHGNLAQEPTDWTTSNTEMCEVGQVCQETLLLIDVGLTSTLVGTKGCSTVGAQNSQKTTIHSAPPGVLVASYTHFCSSDLCNSASSSSVLLNSLPPQAAPVPGDRQCPTCVQPLGTCSSGSPRMTCPRGATHCYDGYIHLSGGGLSTKMSIQGCVAQPSSFLLNHTRQIGIFSAREKRDVQPPASQHEGGGAEGLESLTWGVGLALAPALWWGVVCPSC

SEQ ID NO: 163 - DNA, 2475 bp, Homo Sapien
gaggatttgccacagcagcggatagagcaggagagcaccaccggagcccttgagacatccttgagaagagccacagcataagagactgccctgcttggtgttttgcaggatgatggtggcccttcgaggagcttctgcattgctggttctgttccttgcagcttttctgcccccgccgcagtgtacccaggacccagccatggtgcattacatctaccagcgctttcgagtcttggagcaagggctggaaaaatgtacccaagcaacgagggcatacattcaagaattccaagagttctcaaaaaatatatctgtcatgctgggaagatgtcagacctacacaagtgagtacaagagtgcagtgggtaacttggcactgagagttgaacgtgcccaacgggagattgactacatacaataccttcgagaggctgacgagtgcatcgtatcagaggacaagacactggcagaaatgttgctccaagaagctgaagaagagaaaaagatccggactctgctgaatgcaagctgtgacaacatgctgatgggcataaagtctttgaaaatagtgaagaagatgatggacacacatggctcttggatgaaagatgctgtctataactctccaaaggtgtacttattaattggatccagaaacaacactgtttgggaatttgcaaacatacgggcattcatggaggataacaccaagccagctccccggaagcaaatcctaacactttcctggcagggaacaggccaagtgatctacaaaggttttctattttttcataaccaagcaacttctaatgagataatcaaatataacctgcagaagaggactgtggaagatcgaatgctgctcccaggaggggtaggccgagcattggtttaccagcactccccctcaacttacattgacctggctgtggatgagcatgggctctgggccatccactctgggccaggcacccatagccatttggttctcacaaagattgagccgggcacactgggagtggagcattcatgggataccccatgcagaagccaggatgctgaagcctcattcctcttgtgtggggttctctatgtggtctacagtactgggggccagggccctcatcgcatcacctgcatctatgatccactgggcactatcagtgaggaggacttgcccaacttgttcttccccaagagaccaagaagtcactccatgatccattacaaccccagagataagcagctctatgcctggaatgaaggaaaccagatcatttacaaactccagacaaagagaaagctgcctctgaagtaatgcattacagctgtgagaaagagcactgtggctttggcagctgttctacaggacagtgaggctatagccccttcacaatatagtatccctctaatcacacacaggaagagtgtgtagaagtggaaatacgtatgcctcctttcccaaatgtcactgccttaggtatcttccaagagcttagatgagagcatatcatcaggaaagtttcaacaatgtccattactcccccaaacctcctggctctcaaggatgaccacattctgatacagcctacttcaagccttttgttttactgctccccagcatttactgtaactctgccatcttccctcccacaattagagttgtatgccagcccctaatattcaccactggcttttctctcccctggcctttgctgaagctcttccctctttttcaaatgtctattgatattctcccattttcactgcccaactaaaatactattaatatttctttcttttcttttcttttttttgagacaaggtctcactatgttgcccaggctggtctcaaactccagagctcaagagatcctcctgcctcagcctcctaagtacctgggattacaggcatgtgccaccacacctggcttaaaatactatttcttattgaggtttaacctctatttcccctagccctgtccttccactaagcttggtagatgtaataataaagtgaaaatattaacatttgaatatcgctttccaggtgtggagtgtttgcacatcattgaattctcgtttcacctttgtgaaacatgcacaagtctttacagctgtcattctagagtttaggtgagtaacacaattacaaagtgaaagatacagctagaaaatactacaaatcccatagtttttccattgcccaaggaagcatcaaatacgtatgtttgttcacctactcttatagtcaatgcgttcatcgtttcagcctaaaaataatagtctgtccctttagccagttttcatgtctgcacaagacctttcaataggcctttcaaatgataattcctccagaaaaccagtctaagggtgaggaccccaactctagcctcctcttgtcttgctgtcctctgtttctctctttctgctttaaattcaataaaagtgacactgagcaaaaaaaaaaaaaaa

SEQ ID NO: 164 - protein, 402 aa, Homo Sapien
MMVALRGASALLVLFLAAFLPPPQCTQDPAMVHYIYQRFRVLEQGLEKCTQATRAYIQEFQEFSKNISVMLGRCQTYTSEYKSAVGNLALRVERAQREIDYIQYLREADECIVSEDKTLAEMLLQEAEEEKKIRTLLNASCDNMLMGIKSLKIVKKMMDTHGSWMKDAVYNSPKVYLLIGSRNNTVWEFANIRAFMEDNTKPAPRKQILTLSWQGTGQVIYKGFLFFHNQATSNEIIKYNLQKRTVEDRMLLPGGVGRALVYQHSPSTYIDLAVDEHGLWAIHSGPGTHSHLVLTKIEPGTLGVEHSWDTPCRSQDAEASFLLCGVLYVVYSTGGQGPHRITCIYDPLGTISEEDLPNLFFPKRPRSHSMIHYNPRDKQLYAWNEGNQIIYKLQTKRKLPLK

SEQ ID NO: 165 - DNA, 1415 bp, Homo Sapien
tggcctccccagcttgccaggcacaaggctgagcgggaggaagcgagaggcatctaagcaggcagtgttttgccttcaccccaagtgaccatgagaggtgccacgcgagtctcaatcatgctcctcctagtaactgtgtctgactgtgctgtgatcacaggggcctgtgagcgggatgtccagtgtggggcaggcacctgctgtgccatcagcctgtggcttcgagggctgcggatgtgcaccccgctggggcgggaaggcgaggagtgccaccccggcagccacaaggtccccttcttcaggaaacgcaagcaccacacctgtccttgcttgcccaacctgctgtgctccaggttcccggacggcaggtaccgctgctccatggacttgaagaacatcaatttttaggcgcttgcctggtctcaggatacccaccatccttttcctgagcacagcctggatttttatttctgccatgaaacccagctcccatgactctcccagtccctacactgactaccctgatctctcttgtctagtacgcacatatgcacacaggcagacatacctcccatcatgacatggtccccaggctggcctgaggatgtcacagcttgaggctgtggtgtgaaaggtggccagcctggttctcttccctgctcaggctgccagagaggtggtaaatggcagaaaggacattccccctcccctccccaggtgacctgctctctttcctgggccctgcccctctccccacatgtatccctcggtctgaattagacattcctgggcacaggctcttgggtgcattgctcagagtcccaggtcctggcctgaccctcaggcccttcacgtgaggtctgtgaggaccaatttgtgggtagttcatcttccctcgattggttaactccttagtttcagaccacagactcaagattggctcttcccagagggcagcagacagtcaccccaaggcaggtgtagggagcccagggaggccaatcagccccctgaagactctggtcccagtcagcctgtggcttgtggcctgtgacctgtgaccttctgccagaattgtcatgcctctgaggccccctcttaccacactttaccagttaaccactgaagcccccaattcccacagcttttccattaaaatgcaaatggtggtggttcaatctaatctgatattgacatattagaaggcaattagggtgtttccttaaacaactcctttccaaggatcagccctgagagcaggttggtgactttgaggagggcagtcctctgtccagattggggtgggagcaagggacagggagcagggcaggggctgaaaggggcactgattcagaccagggaggcaactacacaccaacatgctggctttagaataaaagcaccaactgaaaaaa

SEQ ID NO: 166 - protein, 105 aa, Homo Sapien
MRGATRVSIMLLLVTVSDCAVITGACERDVQCGAGTCCAISLWLRGLRMCTPLGREGEECHPGSHKVPFFRKRKHHTCPCLPNLLCSRFPDGRYRCSMDLKNINF

SEQ ID NO: 167 - DNA, 1371 bp, Homo Sapien
aactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaacaattttagatggaagctgagatgatttccaagaacaagaaccctagtatttcttgaagttaatggaaacttttctttggcttttccagttgtgacccgttttccaaccagttctgcagcatattagattctagacaagcaacacccctctggagccagcacagtgctcctccatatcaccagtcatacacagcctcattattaaggtcttatttaatttcagagtgtaaattttttcaagtgctcattaggttttataaacaagaagctacatttttgcccttaagacactacttacagtgttatgacttgtatacacatatattggtatcaaaggggataaaagccaatttgtctgttacatttcctttcacgtatttcttttagcagcacttctgctactaaagttaatgtgtttactctctttccttcccacattctcaattaaaaggtgagctaagcctcctcggtgtttctgattaacagtaaatcctaaattcaaactgttaaatgacatttttatttttatgtctctccttaactatgagacacatcttgttttactgaatttctttcaatattccaggtgatagatttttgtcg

SEQ ID NO: 168 - protein, 215 aa, Homo Sapien
MYGKSSTRAVLLLLGIQLTALWPIAAVEIYTSRVLEAVNGTDARLKCTFSSFAPVGDALTVTWNFRPLDGGPEQFVFYYHIDPFQPMSGRFKDRVSWDGNPERYDASILLWKLQFDDNGTYTCQVKNPPDVDGVIGEIRLSVVHTVRFSEIHFLALAIGSACALMIIIVIVVVLFQHYRKKRWAERAHKVVEIKSKEEERLNQEKKVSVYLEDTD

SEQ ID NO: 169 - DNA, 2213 bp, Homo Sapien
gagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccgagatcacgccactgcactccagcctggcaacagagcgagactccatctcaaaaaaaaaaaaaa

SEQ ID NO: 170 - protein, 335 aa, Homo Sapien
MAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMLNMNSAPTFINFPAKGKPKRGDTYELQVRGFSAEQIARWIADRTDVNIRVIRPPNYAGPLMLGLLLAVIGGLVYLRRSNMEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMS

SEQ ID NO: 171 - DNA, 771 bp, Homo Sapien
ctccactgcaaccacccagagccatggctccccgaggctgcatcgtagctgtctttgccattttctgcatctccaggctcctctgctcacacggagccccagtggcccccatgactccttacctgatgctgtgccagccacacaagagatgtggggacaagttctacgaccccctgcagcactgttgctatgatgatgccgtcgtgcccttggccaggacccagacgtgtggaaactgcaccttcagagtctgctttgagcagtgctgcccctggaccttcatggtgaagctgataaaccagaactgcgactcagcccggacctcggatgacaggctttgtcgcagtgtcagctaatggaacatcaggggaacgatgactcctggattctccttcctgggtgggcctggagaaagaggctggtgttacctgagatctgggatgctgagtggctgtttgggggccagagaaacacacactcaactgcccacttcattctgtgacctgtctgaggcccaccctgcagctgccctgaggaggcccacaggtccccttctagaattctggacagcatgagatgcgtgtgctgatgggggcccagggactctgaaccctcctgatgacccctatggccaacatcaacccggcaccaccccaaggctggctggggaacccttcacccttctgtgagattttccatcatctcaagttctcttctatccaggagcaaagcacaggatcataataaatttatgtactttataaatgaaaa

SEQ ID NO: 172 - protein, 110 aa, Homo Sapien
MAPRGCIVAVFAIFCISRLLCSHGAPVAPMTPYLMLCQPHKRCGDKFYDPLQHCCYDDAVVPLARTQTCGNCTFRVCFEQCCPWTFMVKLINQNCDSARTSDDRLCRSVS

SEQ ID NO: 173 - DNA, 2044 bp, Homo Sapien
gggggcgggtgcctggagcacggcgctggggccgcccgcagcgctcactcgctcgcactcagtcgcgggaggcttccccgcgccggccgcgtcccgcccgctccccggcaccagaagttcctctgcgcgtccgacggcgacatgggcgtccccacggccctggaggccggcagctggcgctggggatccctgctcttcgctctcttcctggctgcgtccctaggtccggtggcagccttcaaggtcgccacgccgtattccctgtatgtctgtcccgaggggcagaacgtcaccctcacctgcaggctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggcctctactgctgcctggtggtggagatcaggcaccaccactcggagcacagggtccatggtgccatggagctgcaggtgcagacaggcaaagatgcaccatccaactgtgtggtgtacccatcctcctcccaggatagtgaaaacatcacggctgcagccctggctacgggtgcctgcatcgtaggaatcctctgcctccccctcatcctgctcctggtctacaagcaaaggcaggcagcctccaaccgccgtgcccaggagctggtgcggatggacagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctggaccctgtccctgactctccaaactttgaggtcatctagcccagctgggggacagtgggctgttgtggctgggtctggggcaggtgcatttgagccagggctggctctgtgagtggcctccttggcctcggccctggttccctccctcctgctctgggctcagatactgtgacatcccagaagcccagcccctcaacccctctggatgctacatggggatgctggacggctcagcccctgttccaaggattttggggtgctgagattctcccctagagacctgaaattcaccagctacagatgccaaatgacttacatcttaagaagtctcagaacgtccagcccttcagcagctctcgttctgagacatgagccttgggatgtggcagcatcagtgggacaagatggacactgggccaccctcccaggcaccagacacagggcacggtggagagacttctcccccgtggccgccttggctcccccgttttgcccgaggctgctcttctgtcagacttcctctttgtaccacagtggctctggggccaggcctgcctgcccactggccatcgccaccttccccagctgcctcctaccagcagtttctctgaagatctgtcaacaggttaagtcaatctggggcttccactgcctgcattccagtccccagagcttggtggtcccgaaacgggaagtacatattggggcatggtggcctccgtgagcaaatggtgtcttgggcaatctgaggccaggacagatgttgccccacccactggagatggtgctgagggaggtgggtggggccttctgggaaggtgagtggagaggggcacctgccccccgccctccccatcccctactcccactgctcagcgcgggccattgcaagggtgccacacaatgtcttgtccaccctgggacacttctgagtatgaagcgggatgctattaaaaactacatggggaaaaaaaaaaaaaaaaaaaaaaaaaaaaaaaaaaaaaga

SEQ ID NO: 174 - protein, 311 aa, Homo Sapien
MGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 175 - DNA, 693 bp, Homo Sapien
ctagcctgcgccaaggggtagtgagaccgcgcggcaacagcttgcggctgcggggagctcccgtgggcgctccgctggctgtgcaggcggccatggattccttgcggaaaatgctgatctcagtcgcaatgctgggcgcaggggctggcgtgggctacgcgctcctcgttatcgtgaccccgggagagcggcggaagcaggaaatgctaaaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgccagcgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtgagctgccgtcgggtgagcacgtttcccccaaaccctggactgactgctttaaggtccgcaaggcgggccagggccgagacgcgagtcggatgtggtgaactgaaagaaccaataaaatcatgttcctccaaaaaaaaaaaaaaaaaaaaaaaaaaaaaaaaaaaaaaaaaaaaaaaaaaaaaaaaaaaaa

SEQ ID NO: 176 - protein, 93 aa, Homo Sapien [sequence omitted]

SEQ ID NO: 177 - DNA, 1700 bp, Homo Sapien
gccaggcaggtgggcctcaggaggtgcctccaggcggccagtgggcctgaggccccagcaagggctagggtccatctccagtcccaggacacagcagcggccaccatggccacgcctgggctccagcagcatcagagcagcccctgtggttggcagcaaagttcagcttggctgggcccgctgtgaggggcttcgcgctacgccctgcggtgtcccgagggctgaggtctcctcatcttctccctagcagtggatgagcaacccaacgggggcccggggaggggaactggccccgagggagaggaaccccaaagccacatctgtagccaggatgagcagtgtgaatccaggcagcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcatcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgctccaggctggactgagcccctcacgccgccctgcagcccccatgcccctgcccaacatgctgggggtccagaagccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtggaccctcagctgagggaaggtacgagctccctgctggagcctgggacccatggcacaggccaggcagcccggaggctgggtggggcctcagtgggggctgctgcctgacccccagcacaataaaaatgaaacgtg

SEQ ID NO: 178 - protein, 273 aa, Homo Sapien [sequence omitted]

SEQ ID NO: 179 - DNA, 2052 bp, Homo Sapien
gacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaaaaaaa

SEQ ID NO: 180 - protein, 500 aa, Homo Sapien
MALMLSLVLSLLKLGSGQWQVFGPDKPVQALVGEDAAFSCFLSPKTNAEAMEVRFFRGQFSSVVHLYRDGKDQPFMQMPQYQGRTKLVKDSIAEGRISLRLENITVLDAGLYGCRISSQSYYQKAIWELQVSALGSVPLISITGYVDRDIQLLCQSSGWFPRPTAKWKGPQGQDLSTDSRTNRDMHGLFDVEISLTVQENAGSISCSMRHAHLSREVESRVQIGDTFFEPISWHLATKVLGILCCGLFFGIVGLKIFFSKFQWKIQAELDWRRKHGQAELRDARKHAVEVTLDPETAHPKLCVSDLKTVTHRKAPQEVPHSEKRFTRKSVVASQSFQAGKHYWEVDGGHNKRWRVGVCRDDVDRRKEYVTLSPDHGYWVLRLNGEHLYFTLNPRFISVFPRTPPTKIGVFLDYECGTISFFNINDQSLIYTLTCRFEGLLRPYIEYPSYNEQNGTPIVICPVTQESEKEASWQRASAIPETSNSESSSQATTPFLPRGEM

SEQ ID NO: 181 - DNA, 2294 bp, Homo Sapien
gcgatggtgcgcccggtggcggtggcggcggcggttgcggaggcttccttggtcggattgcaacgaggagaagatgactgaccaaccgactggctgaatgaatgaatggcggagccgagcgcgccatgaggagcctgccgagcctgggcggcctcgccctgttgtgctgcgccgccgccgccgccgccgtcgcctcagccgcctcggcggggaatgtcaccggtggcggcggggccgcggggcaggtggacgcgtcgccgggccccgggttgcggggcgagcccagccaccccttccctagggcgacggctcccacggcccaggccccgaggaccgggcccccgcgcgccaccgtccaccgacccctggctgcgacttctccagcccagtccccggagaccacccctctttgggcgactgctggaccctcttccaccacctttcaggcgccgctcggcccctcgccgaccacccctccggcggcggaacgcacttcgaccacctctcaggcgccgaccagacccgcgccgaccaccctttcgacgaccactggcccggcgccgaccacccctgtagcgaccaccgtaccggcgcccacgactccccggaccccgacccccgatctccccagcagcagcaacagcagcgtcctccccaccccacctgccaccgaggccccctcttcgcctcctccagagtatgtatgtaactgctctgtggttggaagcctgaatgtgaatcgctgcaaccagaccacagggcagtgtgagtgtcggccaggttatcaggggcttcactgtgaaacctgcaaagagggcttttacctaaattacacttctgggctctgtcagccatgtgactgtagtccacatggagctctcagcataccgtgcaacaggtaagcaacagagggtggaactgaagtttattttattttagcaagggaaaaaaaaaggctgctactctcaaggaccatactggtttaaacaaaggaggatgagggtcatagatttacaaaatattttatatacttttattctcttactttatatgttatatttaatgtcaggatttaaaaacatctaatttactgatttagttcttcaaaagcactagagtcgccaatttttctctgggataatttctgtaaatttcatgggaaaaaattattgaagaataaatctgctttctggaagggctttcaggcatgaaacctgctaggaggtttagaaatgttcttatgtttattaatataccattggagtttgaggaaatttgttgtttggtttatttttctctctaatcaaaattctacatttgtttctttggacatctaaagcttaacctgggggtaccctaatttatttaactagtggtaagtagactggttttactctatttaccagtacatttttgagaccaaaagtagattaagcaggaattatctttaaactattatgttatttggaggtaatttaatctagtggaataatgtactgttatctaagcatttgccttgtactgcactgaaagtaattattctttgaccttatgtgaggcacttggctttttgtggaccccaagtcaaaaaactgaagagacagtattaaataatgaaaaaaataatgacaggttatactcagtgtaacctgggtataacccaagatctgctgccacttacgagctgtgttccttgggcaagtaatttcctttcactgagcttgtttcttctcaaggttgttgtgaagattaaatgagttgatatatataaaatgcctagcacatgtcactcaataaattctggtttgttttaatttcaaaggaatattatggactgaaatgagagaacatgttttaagaacttttagctccttgacaaagaagtgctttatactttagcactaaatattttaaatgctttataaatgatattatactgttatggaatattgtatcatattgtagtttattaaaaatgtagaagaggctgggcgcggtggctcacgcctgtaatcctagcactttgggaggccaaggcgggtggatcacttgaggccaggagttctagatgagcctggccagcacagtgaaaccccgtctctactaaaaatacaaacaaattagctgggcgtggtggcacacacctgtagtcccagctactcgggaggctgaggcaggagaatcggttgaacccgggaggtggaggttgcagtgagctgagatcgcgccactgcactccagcctggtgagagagggagactctgtcttaaaaaaaaaaaaaaaaaaaaaaaaaa

SEQ ID NO: 182 - protein, 258 aa, Homo Sapien
MRSLPSLGGLALLCCAAAAAAVASAASAGNVTGGGGAAGQVDASPGPGLRGEPSHPFPRATAPTAQAPRTGPPRATVHRPLAATSPAQSPETTPLWATAGPSSTTFQAPLGPSPTTPPAAERTSTTSQAPTRPAPTTLSTTTGPAPTTPVATTVPAPTTPRTPTPDLPSSSNSSVLPTPPATEAPSSPPPEYVCNCSVVGSLNVNRCNQTTGQCECRPGYQGLHCETCKEGFYLNYTSGLCQPCDCSPHGALSIPCNR

SEQ ID NO: 183 - DNA, 689 bp, Homo Sapien
tgcggcgcagtgtagacctgggaggatgggcggcctgctgctggctgcttttctggctttggtctcggtgcccagggcccaggccgtgtggttgggaagactggaccctgagcagcttcttgggccctggtacgtgcttgcggtggcctcccgggaaaagggctttgccatggagaaggacatgaagaacgtcgtgggggtggtggtgaccctcactccagaaaacaacctgcggacgctgtcctctcagcacgggctgggagggtgtgaccagagtgtcatggacctgataaagcgaaactccggatgggtgtttgagaatccctcaataggcgtgctggagctctgggtgctggccaccaacttcagagactatgccatcatcttcactcagctggagttcggggacgagcccttcaacaccgtggagctgtacagtctgacggagacagccagccaggaggccatggggctcttcaccaagtggagcaggagcctgggcttcctgtcacagtagcaggcccagctgcagaaggacctcacctgtgctcacaagatccttctgtgagtgctgcgtccccagtagggatggcgcccacagggtcctgtgacctcggccagtgtccacccacctcgctcagcggctcccggggcccagcaccagctcagaataaagcgattccacagca

SEQ ID NO: 184 - protein, 163 aa, Homo Sapien
MGGLLLAAFLALVSVPRAQAVWLGRLDPEQLLGPWYVLAVASREKGFAMEKDMKNVVGVVVTLTPENNLRTLSSQHGLGGCDQSVMDLIKRNSGWVFENPSIGVLELWVLATNFRDYAIIFTQLEFGDEPFNTVELYSLTETASQEAMGLFTKWSRSLGFLSQ

SEQ ID NO: 185 - DNA, 1204 bp, Homo Sapien
gttccgcagatgcagaggttgaggtggctgcgggactggaagtcatcgggcagaggtctcacagcagccaaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgaaaaaaaaaaaaaaaaaaaaaaaaaaaaaaaaaaaaaa

SEQ ID NO: 186 - protein, 250 aa, Homo Sapien
MRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 187 - DNA, 2848 bp, Homo Sapien
gctcaagtgccctgccttgccccacccagcccagcctggccagagccccctggagaaggagctctcttcttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccaggtacactggagtgggggtgatgtgcactatcacctggagagccatcccccgggaccctttgaagtgaatgcagagggaaacctctacgtgaccagagagctggacagagaagcccaggctgagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatgggaaaaaaaaaaaaaaaaaaaaaaaaaaaaaaaaag

SEQ ID NO: 188 - protein, 807 aa, Homo Sapien
MVPAWLWLLCVSVPQALPKAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEVSIIESTWVSLEPIHLAENLKVLYPHHMAQVHWSGGDVHYHLESHPPGPFEVNAEGNLYVTRELDREAQAEYLLQVRAQNSHGEDYAAPLELHVLVMDENDNVPICPPRDPTVSIPELSPPGTEVTRLSAEDADAPGSPNSHVVYQLLSPEPEDGVEGRAFQVDPTSGSVTLGVLPLRAGQNILLLVLAMDLAGAEGGFSSTCEVEVAVTDINDHAPEFITSQIGPISLPEDVEPGTLVAMLTAIDADLEPAFRLMDFAIERGDTEGTFGLDWEPDSGHVRLRLCKNLSYEAAPSHEVVVVVQSVAKLVGPGPGPGATATVTVLVERVMPPPKLDQESYEASVPISAPAGSFLLTIQPSDPISRTLRFSLVNDSEGWLCIEKFSGEVHTAQSLQGAQPGDTYTVLVEAQDTALTLAPVPSQYLCTPRQDHGLIVSGPSKDPDLASGHGPYSFTLGPNPTVQRDWRLQTLNGSHAYLTLALHWVEPREHIIPVVVSHNAQMWQLLVRVIVCRCNVEGQCMRKVGRMKGMPTKLSAVGILVGTLVAIGIFLILIFTHWTMSRKKDPDQPADSVPLKATV

SEQ ID NO: 189 - DNA, 2668 bp, Homo Sapien
gactttgcttgaatgtttacattttctgctcgctgtcctacatatcacaatatagtgttcacgttttgttaaaactttggggtgtcaggagttgagcttgctcagcaagccagcatggctaggatgagctttgttatagcagcttgccaattggtgctgggcctactaatgacttcattaaccgagtcttccatacagaatagtgagtgtccacaactttgcgtatgtgaaattcgtccctggtttaccccacagtcaacttacagagaagccaccactgttgattgcaatgacctccgcttaacaaggattcccagtaacctctctagtgacacacaagtgcttctcttacagagcaataacatcgcgaagactgtggatgagctgcagcagcttttcaacttgactgaactagatttctcccaaaacaactttactaacattaaggaggtcgggctggcaaacctaacccagctcacaacgctgcatttggaggaaaatcagattaccgagatgactgattactgtctacaagacctcagcaaccttcaagaactctacatcaaccacaaccaaattagcactatttctgctcatgcttttgcaggcttaaaaaatctattaaggctccacctgaactccaacaaattgaaagttattgatagtcgctggtttgattctacacccaacctggaaattctcatgatcggagaaaaccctgtgattggaattctggatatgaacttcaaacccctcgcaaatttgagaagcttagttttggcaggaatgtatctcactgatattcctggaaatgctttggtgggtctggatagccttgagagcctgtctttttatgataacaaactggttaaagtccctcaacttgccctgcaaaaagttccaaatttgaaattcttagacctcaacaaaaaccccattcacaaaatccaagaaggggacttcaaaaatatgcttcggttaaaagaactgggaatcaacaatatgggcgagctcgtttctgtcgaccgctatgccctggataacttgcctgaactcacaaagctggaagccaccaataaccctaaactctcttacatccaccgcttggctttccgaagtgtccctgctctggaaagcttgatgctgaacaacaatgccttgaatgccatttaccaaaagacagtcgaatccctccccaatctgcgtgagatcagtatccatagcaatcccctcaggtgtgactgtgtgatccactggattaactccaacaaaaccaacatccgcttcatggagcccctgtccatgttctgtgccatgccgcccgaatataaagggcaccaggtgaaggaagttttaatccaggattcgagtgaacagtgcctcccaatgatatctcacgacagcttcccaaatcgtttaaacgtggatatcggcacgacggttttcctagactgtcgagccatggctgagccagaacctgaaatttactgggtcactcccattggaaataagataactgtggaaaccctttcagataaatacaagctaagtagcgaaggtaccttggaaatatctaacatacaaattgaagactcaggaagatacacatgtgttgcccagaatgtccaaggggcagacactcgggtggcaacaattaaggttaacgggacccttctggatggtacccaggtgctaaaaatatacgtcaagcagacagaatcccattccatcttagtgtcctggaaagttaattccaatgtcatgacgtcaaacttaaaatggtcgtctgccaccatgaagattgataaccctcacataacatatactgccagggtcccagtcgatgtccatgaatacaacctaacgcatctgcagccttccacagattatgaagtgtgtctcacagtgtccaatattcatcagcagactcaaaagtcatgcgtaaatgtcacaaccaaaaatgccgccttcgcagtggacatctctgatcaagaaaccagtacagcccttgctgcagtaatggggtctatgtttgccgtcattagccttgcgtccattgctgtgtactttgccaaaagatttaagagaaaaaactaccaccactcattaaaaaagtatatgcaaaaaacctcttcaatcccactaaatgagctgtacccaccactcattaacctctgggaaggtgacagcgagaaagacaaagatggttctgcagacaccaagccaacccaggtcgacacatccagaagctattacatgtggtaactcagaggatattttgcttctggtagtaaggagcacaaagacgtttttgctttattctgcaaaagtgaacaagttgaagacttttgtatttttgactttgctagtttgtggcagagtggagaggacgggtggatatttcaaatttttttagtatagcgtatcgcaagggtttgacacggctgccagcgactctaggcttccagtctgtgtttggtttttattcttatcattattatgattgttattatattattattttattttagttgttgtgctaaactcaataatgctgttctaactacagtgctcaataaaatgattaatgacaggaaaaaaaaaaaaaaaaaaaaaaaaaaaaaaaaaaaaaaaaaaaaaaaaaaaaaaaaaaaaaaaaaaaaaaaaa

SEQ ID NO: 190 - protein, 716 aa, Homo Sapien
MARMSFVIAACQLVLGLLMTSLTESSIQNSECPQLCVCEIRPWFTPQSTYREATTVDCNDLRLTRIPSNLSSDTQVLLLQSNNIAKTVDELQQLFNLTELDFSQNNFTNIKEVGLANLTQLTTLHLEENQITEMTDYCLQDLSNLQELYINHNQISTISAHAFAGLKNLLRLHLNSNKLKVIDSRWFDSTPNLEILMIGENPVIGILDMNFKPLANLRSLVLAGMYLTDIPGNALVGLDSLESLSFYDNKLVKVPQLALQKVPNLKFLDLNKNPIHKIQEGDFKNMLRLKELGINNMGELVSVDRYALDNLPELTKLEATNNPKLSYIHRLAFRSVPALESLMLNNNALNAIYQKTVESLPNLREISIHSNPLRCDCVIHWINSNKTNIRFMEPLSMFCAMPPEYKGHQVKEVLIQDSSEQCLPMISHDSFPNRLNVDIGTTVFLDCRAMAEPEPEIYWVTPIGNKITVETLSDKYKLSSEGTLEISNIQIEDSGRYTCVAQNVQGADTRVATIKVNGTLLDGTQVLKIYVKQTESHSILVSWKVNSNVMTSNLKWSSATMKIDNPHITYTARVPVDVHEYNLTHLQPSTDYEVCLTVSNIHQQTQKSCVNVTTKNAAFAVDISDQETSTALAAVMGSMFAVISLASIAVYFAKRFKRKNYHHSLKKYMQKTSSIPLNELYPPLINLWEGDSEKDKDGSADTKPTQVDTSRSYYMW

SEQ ID NO: 191 - DNA, 957 bp, Homo Sapien
gggagagaggataaatagcagcgtggcttccctggctcctctctgcatccttcccgaccttcccagcaatatgcatcttgcacgtctggtcggctcctgctccctccttctgctactgggggccctgtctggatgggcggccagcgatgaccccattgagaaggtcattgaagggatcaaccgagggctgagcaatgcagagagagaggtgggcaaggccctggatggcatcaacagtggaatcacgcatgccggaagggaagtggagaaggttttcaacggacttagcaacatggggagccacaccggcaaggagttggacaaaggcgtccaggggctcaaccacggcatggacaaggttgcccatgagatcaaccatggtattggacaagcaggaaaggaagcagagaagcttggccatggggtcaacaacgctgctggacaggccgggaaggaagcagacaaagcggtccaagggttccacactggggtccaccaggctgggaaggaagcagagaaacttggccaaggggtcaaccatgctgctgaccaggctggaaaggaagtggagaagcttggccaaggtgcccaccatgctgctggccaggccgggaaggagctgcagaatgctcataatggggtcaaccaagccagcaaggaggccaaccagctgctgaatggcaaccatcaaagcggatcttccagccatcaaggaggggccacaaccacgccgttagcctctggggcctcagtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacacca

SEQ ID NO: 192 - protein, 247 aa, Homo Sapien
MHLARLVGSCSLLLLLGALSGWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQAGKEADKAVQGFHTGVHQAGKEAEKLGQGVNHAADQAGKEVEKLGQGAHHAAGQAGKELQNAHNGVNQASKEANQLLNGNHQSGSSSHQGGATTTPLASGASVNTPFINLPALWRSVANIMP

SEQ ID NO: 193 - DNA, 904 bp, Homo Sapien
gaagtagaggtgttgtgctgagcggcgctcggcgaactgtgtggaccgtctgctgggactccggccctgcgtccgctcagccccgtggccccgcgcacctactgccatggagacgcggcctcgtctcggggccacctgtttgctgggcttcagtttcctgctcctcgtcatctcttctgatggacataatgggcttggaaagggttttggagatcatattcattggaggacactggaagatgggaagaaagaagcagctgccagtggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatgaagatttcagccctgacgggggttatattccacgaatcctttttctggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaatgtcaacttgtcattgaatgtaaagaatgaaaccttctgacacaaaa

SEQ ID NO: 194 - protein, 172 aa, Homo Sapien
METRPRLGATCLLGFSFLLLVISSDGHNGLGKGFGDHIHWRTLEDGKKEAAASGLPLMVIIHKSWCGACKALKPKFAESTEISELSHNFVMVNLEDEEEPKDEDFSPDGGYIPRILFLDPSGKVHPEIINENGNPSYKYFYVSAEQVVQGMKEAQERLTGDAFRKKHLEDEL

SEQ ID NO: 195 - DNA, 1630 bp, Homo Sapien
cggctcgagtgcagctgtggggagatttcagtgcattgcctcccctgggtgctcttcatcttggatttgaaagttgagagcagcatgttttgcccactgaaactcatcctgctgccagtgttactggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgagttactgggaagaatcagagataaaaaccaacccaaatcaa

SEQ ID NO: 196 - protein, 394 aa, Homo Sapien
MFCPLKLILLPVLLDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 197 - DNA, 783 bp, Homo Sapien
cgccatggccgggctatcccgcgggtccgcgcgcgcactgctcgccgccctgctggcgtcgacgctgttggcgctgctcgtgtcgcccgcgcggggtcgcggcggccgggaccacggggactgggacgaggcctcccggctgccgccgctaccaccccgcgaggacgcggcgcgcgtggcccgcttcgtgacgcacgtctccgactggggcgctctggccaccatctccacgctggaggcggtgcgcggccggcccttcgccgacgtcctctcgctcagcgacgggcccccgggcgcgggcagcggcgtgccctatttctacctgagcccgctgcagctctccgtgagcaacctgcaggagaatccatatgctacactgaccatgactttggcacagaccaacttctgcaagaaacatggatttgatccacaaagtcccctttgtgttcacataatgctgtcaggaactgtgaccaaggtgaatgaaacagaaatggatattgcaaagcattcgttattcattcgacaccctgagatgaaaacctggccttccagccataattggttctttgctaagttgaatataaccaatatctgggtcctggactactttggtggaccaaaaatcgtgacaccagaagaatattataatgtcacagttcagtgaagcagactgtggtgaatttagcaacacttatgaagtttcttaaagtggctcatacacacttaaaaggcttaatgtttctctggaaagcgtcccagaatattagccagttttctgtc

SEQ ID NO: 198 - protein, 220 aa, Homo Sapien
MAGLSRGSARALLAALLASTLLALLVSPARGRGGRDHGDWDEASRLPPLPPREDAARVARFVTHVSDWGALATISTLEAVRGRPFADVLSLSDGPPGAGSGVPYFYLSPLQLSVSNLQENPYATLTMTLAQTNFCKKHGFDPQSPLCVHIMLSGTVTKVNETEMDIAKHSLFIRHPEMKTWPSSHNWFFAKLNITNIWVLDYFGGPKIVTPEEYYNVTVQ

SEQ ID NO: 199 - DNA, 1315 bp, Homo Sapien
tcgccatggcctctgccggaatgcagatcctgggagtcgtcctgacactgctgggctgggtgaatggcctggtctcctgtgccctgcccatgtggaaggtgaccgctttcatcggcaacagcatcgtggtggcccaggtggtgtgggagggcctgtggatgtcctgcgtggtgcagagcaccggccagatgcagtgcaaggtgtacgactcactgctggcgctgccacaggacctgcaggctgcacgtgccctctgtgtcatcgccctccttgtggccctgttcggcttgctggtctaccttgctggggccaagtgtaccacctgtgtggaggagaaggattccaaggcccgcctggtgctcacctctgggattgtctttgtcatctcaggggtcctgacgctaatccccgtgtgctggacggcgcatgccatcatccgggacttctataaccccctggtggctgaggcccaaaagcgggagctgggggcctccctctacttgggctgggcggcctcaggccttttgttgctgggtggggggttgctgtgctgcacttgcccctcgggggggtcccagggccccagccattacatggcccgctactcaacatctgcccctgccatctctcgggggccctctgagtaccctaccaagaattacgtctgacgtggaggggaatgggggctccgctggcgctagagccatccagaagtggcagtgcccaacagctttgggatgggttcgtaccttttgtttctgcctcctgctatttttcttttgactgaggatatttaaaattcatttgaaaactgagccaaggtgttgactcagactctcacttaggctctgctgtttctcacccttggatgatggagccaaagaggggatgctttgagattctggatcttgacatgcccatcttagaagccagtcaagctatggaactaatgcggaggctgcttgctgtgctggctttgcaacaagacagactgtccccaagagttcctgctgctgctgggggctgggcttccctagatgtcactggacagctgccccccatcctactcaggtctctggagctcctctcttcacccctggaaaaacaaatcatctgttaacaaaggactgcccacctccggaacttctgacctctgtttcctccgtcctgataagacgtccaccccccagggccaggtcccagctatgtagacccccgcccccacctccaacactgcacccttctgccctgcccccctcgtctcaccccctttacactcacatttttatcaaataaagcatgttttgttagtgca

SEQ ID NO: 200 - protein, 220 aa, Homo Sapien
MASAGMQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTCVEEKDSKARLVLTSGIVFVISGVLTLIPVCWTAHAIIRDFYNPLVAEAQKRELGASLYLGWAASGLLLLGGGLLCCTCPSGGSQGPSHYMARYSTSAPAISRGPSEYPTKNYV

SEQ ID NO: 201 - DNA, 535 bp, Homo Sapien
agtgacaatctcagagcagcttctacaccacagccatttccagcatgaagatcactgggggtctccttctgctctgtacagtggtctatttctgtagcagctcagaagctgctagtctgtctccaaaaaaagtggactgcagcatttacaagaagtatccagtggtggccatcccctgccccatcacatacctaccagtttgtggttctgactacatcacctatgggaatgaatgtcacttgtgtaccgagagcttgaaaagtaatggaagagttcagtttcttcacgatggaagttgctaaattctccatggacatagagagaaaggaatgatattctcatcatcatcttcatcatcccaggctctgactgagtttctttcagttttactgatgttctgggtgggggacagagccagattcagagtaatcttgactgaatggagaaagtttctgtgctacccctacaaacccatgcctcactgacagaccagcattttttttttaacacgtcaataaaaaaataatctcccaga

SEQ ID NO: 202 - protein, 85 aa, Homo Sapien
MKITGGLLLLCTVVYFCSSSEAASLSPKKVDCSIYKKYPVVAIPCPITYLPVCGSDYITYGNECHLCTESLKSNGRVQFLHDGSC

SEQ ID NO: 203 - DNA, 2387 bp, Homo Sapien
cgacgatgctacgcgcgcccggctgcctcctccggacctccgtagcgcctgccgcggccctggctgcggcgctgctctcgtcgcttgcgcgctgctctcttctagagccgagggacccggtggcctcgtcgctcagcccctatttcggcaccaagactcgctacgaggatgtcaaccccgtgctattgtcgggccccgaggctccgtggcgggaccctgagctgctggaggggacctgcaccccggtgcagctggtcgccctcattcgccacggcacccgctaccccacggtcaaacagatccgcaagctgaggcagctgcacgggttgctgcaggcccgcgggtccagggatggcggggctagtagtaccggcagccgcgacctgggtgcagcgctggccgactggcctttgtggtacgcggactggatggacgggcagctagtagagaagggacggcaggatatgcgacagctggcgctgcgtctggcctcgctcttcccggcccttttcagccgtgagaactacggccgcctgcggctcatcaccagttccaagcaccgctgcatggatagcagcgccgccttcctgcaggggctgtggcagcactaccaccctggcttgccgccgccggacgtcgcagatatggagtttggacctccaacagttaatgataaactaatgagattttttgatcactgtgagaagtttttaactgaagtagaaaaaaatgctacagctctttatcacgtggaagccttcaaaactggaccagaaatgcagaacattttaaaaaaagttgcagctactttgcaagtgccagtaaatgatttaaatgcagatttaattcaagtagcctttttcacctgttcatttgacctggcaattaaaggtgttaaatctccttggtgtgatgtttttgacatagatgatgcaaaggtattagaatatttaaatgatctgaaacaatattggaaaagaggatatgggtatactattaacagtcgatccagctgcaccttgtttcaggatatctttcagcacttggacaaagcagttgaacagaaacaaaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgactttaaaaaaaaa

SEQ ID NO: 204 - protein, 487 aa, Homo Sapien
MLRAPGCLLRTSVAPAAALAAALLSSLARCSLLEPRDPVASSLSPYFGTKTRYEDVNPVLLSGPEAPWRDPELLEGTCTPVQLVALIRHGTRYPTVKQIRKLRQLHGLLQARGSRDGGASSTGSRDLGAALADWPLWYADWMDGQLVEKGRQDMRQLALRLASLFPALFSRENYGRLRLITSSKHRCMDSSAAFLQGLWQHYHPGLPPPDVADMEFGPPTVNDKLMRFFDHCEKFLTEVEKNATALYHVEAFKTGPEMQNILKKVAATLQVPVNDLNADLIQVAFFTCSFDLAIKGVKSPWCDVFDIDDAKVLEYLNDLKQYWKRGYGYTINSRSSCTLFQDIFQHLDKAVEQKQRSQPISSPVILQFGHAETLLPLLSLMGYFKDKEPLTAYNYKKQMHRKFRSGLIVPYASNLIFVLYHCENAKTPKEQFRVQMLLNEKVLPLAYSQETVSFYEDLKNHYKDILQSCQTSEECELARANSTSDEL

SEQ ID NO: 205 - DNA, 1098 bp, Homo Sapien
gcgacgcgcggcggggcggcgagaggaaacgcggcgccgggccgggcccggccctggagatggtccccggcgccgcgggctggtgttgtctcgtgctctggctccccgcgtgcgtcgcggcccacggcttccgtatccatgattatttgtactttcaagtgctgagtcctggggacattcgatacatcttcacagccacacctgccaaggactttggtggtatctttcacacaaggtatgagcagattcaccttgtccccgctgaacctccagaggcctgcggggaactcagcaacggtttcttcatccaggaccagattgctctggtggagagggggggctgctccttcctctccaagactcgggtggtccaggagcacggcgggcgggcggtgatcatctctgacaacgcagttgacaatgacagcttctacgtggagatgatccaggacagtacccagcgcacagctgacatccccgccctcttcctgctcggccgagacggctacatgatccgccgctctctggaacagcatgggctgccatgggccatcatttccatcccagtcaatgtcaccagcatccccacctttgagctgctgcaaccgccctggaccttctggtagaagagtttgtcccacattccagccataagtgactctgagctgggaaggggaaacccaggaattttgctacttggaatttggagatagcatctggggacaagtggagccaggtagaggaaaagggtttgggcgttgctaggctgaaagggaagccacaccactggccttcccttccccagggcccccaagggtgtctcatgctacaagaagaggcaagagacaggccccagggcttctggctagaacccgaaacaaaaggagctgaaggcaggtggcctgagagccatctgtgacctgtcacactcacctggctccagcctcccctacccagggtctctgcacagtgaccttcacagcagttgttggagtggtttaaagagctggtgtttggggactcaataaaccctcactgactttttagcaataaagcttctcatcagggttgcaaaaaaaaaaaaaaaaaaaaaaaaaa

SEQ ID NO: 206 - protein, 188 aa, Homo Sapien
MVPGAAGWCCLVLWLPACVAAHGFRIHDYLYFQVLSPGDIRYIFTATPAKDFGGIFHTRYEQIHLVPAEPPEACGELSNGFFIQDQIALVERGGCSFLSKTRVVQEHGGRAVIISDNAVDNDSFYVEMIQDSTQRTADIPALFLLGRDGYMIRRSLEQHGLPWAIISIPVNVTSIPTFELLQPPWTFW

SEQ ID NO: 207 - DNA, 764 bp, Homo Sapien
ctcgcttcttccttctggatgggggcccagggggcccaggagagtataaaggcgatgtggagggtgcccggcacaaccagacgcccagtcacaggcgagagccctgggatgcaccggccagaggccatgctgctgctgctcacgcttgccctcctggggggccccacctgggcagggaagatgtatggccctggaggaggcaagtatttcagcaccactgaagactacgaccatgaaatcacagggctgcgggtgtctgtaggtcttctcctggtgaaaagtgtccaggtgaaacttggagactcctgggacgtgaaactgggagccttaggtgggaatacccaggaagtcaccctgcagccaggcgaatacatcacaaaagtctttgtcgccttccaagctttcctccggggtatggtcatgtacaccagcaaggaccgctatttctattttgggaagcttgatggccagatctcctctgcctaccccagccaagaggggcaggtgctggtgggcatctatggccagtatcaactccttggcatcaagagcattggctttgaatggaattatccactagaggagccgaccactgagccaccagttaatctcacatactcagcaaactcacccgtgggtcgctagggtggggtatggggccatccgagctgaggccatctgtgtggtggtggctgatggtactggagtaactgagtcgggacgctgaatctgaatccaccaataaataaagcttctgcagaaaa

SEQ ID NO: 208 - protein, 178 aa, Homo Sapien
MHRPEAMLLLLTLALLGGPTWAGKMYGPGGGKYFSTTEDYDHEITGLRVSVGLLLVKSVQVKLGDSWDVKLGALGGNTQEVTLQPGEYITKVFVAFQAFLRGMVMYTSKDRYFYFGKLDGQISSAYPSQEGQVLVGIYGQYQLLGIKSIGFEWNYPLEEPTTEPPVNLTYSANSPVGR

SEQ ID NO: 209 - DNA, 3824 bp, Homo Sapien
ggagaatggagagagcagtgagagtggagtccggggtcctggtcggggtggtctgtctgctcctggcatgccctgccacagccactgggcccgaagttgctcagcctgaagtagacaccaccctgggtcgtgtgcgaggccggcaggtgggcgtgaagggcacagaccgccttgtgaatgtctttctgggcattccatttgcccagccgccactgggccctgaccggttctcagccccacacccagcacagccctgggagggtgtgcgggatgccagcactgcgcccccaatgtgcctacaagacgtggagagcatgaacagcagcagatttgtcctcaacggaaaacagcagatcttctccgtttcagaggactgcctggtcctcaacgtctatagcccagctgaggtccccgcagggtccggtaggccggtcatggtatgggtccatggaggcgctctgataactggcgctgccacctcctacgatggatcagctctggctgcctatggggatgtggtcgtggttacagtccagtaccgccttggggtccttggcttcttcagcactggagatgagcatgcacctggcaaccagggcttcctagatgtggtagctgctttgcgctgggtgcaagaaaacatcgcccccttcgggggtgacctcaactgtgtcactgtctttggtggatctgccggtgggagcatcatctctggcctggtcctgtccccagtggctgcagggctgttccacagagccatcacacagagtggggtcatcaccaccccagggatcatcgactctcacccttggcccctagctcagaaaatcgcaaacaccttggcctgcagctccagctccccggctgagatggtgcagtgccttcagcagaaagaaggagaagagctggtccttagcaagaagctgaaaaatactatctatcctctcaccgttgatggcactgtcttccccaaaagccccaaggaactcctgaaggagaagcccttccactctgtgcccttcctcatgggtgtcaacaaccatgagttcagctggctcatccccaggggctggggtctcctggatacaatggagcagatgagccgggaggacatgctggccatctcaacacccgtcttgaccagtctggatgtgccccctgagatgatgcccaccgtcatagatgaatacctaggaagcaactcggacgcacaagccaaatgccaggcgttccaggaattcatgggtgacgtattcatcaatgttcccaccgtcagtttttcaagataccttcgagattctggaagccctgtctttttctatgagttccagcatcgacccagttcttttgcgaagatcaaacctgcctgggtgaaggctgatcatggggccgagggtgcttttgtgttcggaggtcccttcctcatggacgagagctcccgcctggcctttccagaggccacagaggaggagaagcagctaagcctcaccatgatggcccagtggacccactttgcccggacaggggaccccaatagcaaggctctgcctccttggccccaattcaaccaggcggaacaatatctggagatcaacccagtgccacgggccggacagaagttcagggaggcctggatgcagttctggtcagagacgctccccagcaagatacaacagtggcaccagaagcagaagaacaggaaggcccaggaggacctctgaggccaggcctgaaccttcttggctggggcaaaccactcttcaagtggtggcagagtcccagcacggcagcccgcctctccccctgctgagactttaatctccaccagcccttaaagtgtcggccgctctgtgactggagttatgctcttttgaaatgtcacaaggccgcctcccacctctggggcattgtacaagttcttccctctccctgaagtgcctttcctgctttcttcgtggtaggttctagcacattcctctagcttcctggaggactcactccccaggaagccttccctgccttctctgggctgtgcggccccgagtctgcgtccattagagcacagtccacccgaggctagcaccgtgtctgtgtctgtctccccctcagaggagctctctcaaaatggggattagcctaaccccactctgtcacccacaccaggatcgggtgggacctggagctagggggtgtttgctgagtgagtgagtgaaacacagaatatgggaatggcagctgctgaacttgaacccagagccttcaggtgccaaagccatactcaggcccccaccgacattgtccaccctggccagaagggtgcatgccaatggcagagacctgggatgggagaagtcctggggcgccaggggatccagcctagagcagaccttagcccctgactaaggcctcagactagggcgggaggggtctcctcctctctgctgcccagtcctggcccctgcacaagacaacagaatccatcagggccatgagtgtcacccagacctgaccctcaccaattccagcccctgaccctcaggacgctggatgccagctcccagccccagtgccgggtcctccctcccttcctggcttggggagaccagtttctggggagcttccaagagcacccaccaagacacagcaggacaggccaggggagggcatctggaccagggcatccgtcgggctattgtcacagagaaaagaagagacccacccactcgggctgcaaaaggtgaaaagcaccaagaggttttcagatggaagtgagaggtgacagtgtgctggcagccctcacagccctcgcttgctctccctgccgcctctgcctgggctcccactttggcagcacttgaggagcccttcaacccgccgctgcactgtaggagcccctttctgggctggccaaggccggagccagctccctcagcttgcggggaggtgcggagggagaggggcgggcaggaaccggggctgcgcgcagcgcttgcgggccagagtgagttccgggtgggcgtgggctcggcggggccccactcagagcagctggccggccccaggcagtgagggccttagcacctgggccagcagctgctgtgctcgatttctcgctgggccttagctgcctccccgcggggcagggctcgggacctgcagccctccatgcctgaccctccccccaccccccgtgggctcctgtgcggccggagcctccccaaggagcgccgccccctgctccacagcgcccagtcccatcgaccacccaagggctgaggagtgcgggtgcacagcgcgggactggcaggcagctccacctgctgccccagtgctggatccactgggtgaagccagctgggctcctgagtctggtggggacttggagaacctttatgtctagctaagggattgtaaatacaccgatgggcactctgtatctagctcaaggtttgtaaacacaccaatcagcaccctgtgtctagctcagtgtttgtgaatgcaccaatccacactctgtatctggctactctggtggggacttggagaacctttgtgtccacactctgtatctagctaatctagtggggatgtggagaacctttgtgtctagctcagggatcgtaaacgcaccaatcagcaccctgtcaaaacagaccacttgactctctgtaaaatggaccaatcagcaggatgtgggtggggcgagacaagagaataaaagcaggctgcctgagccagcagtgacaacccccctcgggtcccctcccacgccgtggaagctttgttctttcgctctttgcaataaatcttgctactgcccaaaa

SEQ ID NO: 210 - protein, 571 aa, Homo Sapien
MERAVRVESGVLVGVVCLLLACPATATGPEVAQPEVDTTLGRVRGRQVGVKGTDRLVNVFLGIPFAQPPLGPDRFSAPHPAQPWEGVRDASTAPPMCLQDVESMNSSRFVLNGKQQIFSVSEDCLVLNVYSPAEVPAGSGRPVMVWVHGGALITGAATSYDGSALAAYGDVVVVTVQYRLGVLGFFSTGDEHAPGNQGFLDVVAALRWVQENIAPFGGDLNCVTVFGGSAGGSIISGLVLSPVAAGLFHRAITQSGVITTPGIIDSHPWPLAQKIANTLACSSSSPAEMVQCLQQKEGEELVLSKKLKNTIYPLTVDGTVFPKSPKELLKEKPFHSVPFLMGVNNHEFSWLIPRGWGLLDTMEQMSREDMLAISTPVLTSLDVPPEMMPTVIDEYLGSNSDAQAKCQAFQEFMGDVFINVPTVSFSRYLRDSGSPVFFYEFQHRPSSFAKIKPAWVKADHGAEGAFVFGGPFLMDESSRLAFPEATEEEKQLSLTMMAQWTHFARTGDPNSKALPPWPQFNQAEQYLEINPVPRAGQKFREAWMQFWSETLPSKIQQWHQKQKNRKAQEDL

SEQ ID NO: 211 - DNA, 1177 bp, Homo Sapien
aacttctacatgggcctcctgctgctggtgctcttcctcagcctcctgccggtggcctacaccatcatgtccctcccaccctcctttgactgcgggccgttcaggtgcagagtctcagttgcccgggagcacctcccctcccgaggcagtctgctcagagggcctcggcccagaattccagttctggtttcatgccagcctgtaaaaggccatggaactttgggtgaatcaccgatgccatttaagagggttttctgccaggatggaaatgttaggtcgttctgtgtctgcgctgttcatttcagtagccaccagccacctgtggccgttgagtgcttgaaatgaggaactgagaaaattaatttctcatgtatttttctcatttatttattaatttttaactgatagttgtacatatttgggggtacatgtgatatttggatacatgtatacaatatataatgatcaaatcagggtaactgggatatccatcacatcaaacatttattttttattctttttagacagagtctcactctgtcacccaggctggagtgcagtggtgccatctcagcttactgcaacctctgcctgccaggttcaagcgattctcatgcctccacctcccaagtagctgggactacaggcatgcaccacaatgcccaactaatttttgtatttttagtagagacggggttttgccatgttgcccaggctggccttgaactcctggcctcaaacaatccacttgcctcggcctcccaaagtgttatgattacaggcgtgagccaccgtgcctggcctaaacatttatcttttctttgtgttgggaactttgaaattatacaatgaattattgttaactgtcatctccctgctgtgctatggaacactgggacttcttccctctatctaactgtatatttgtaccagttaaccaaccgtacttcatccccactcctctctatccttcccaacctctgatcacctcattctactctctacctccatgagatccacttttttagctcccacatgtgagtaagaaaatgcaatatttgtctttctgtgcctggcttatttcacttaacataatgacttcctgttccatccatgttgctgcaaatgacaggatttcgttcttaatttcaattaaaataaccacacatggcaaaaa

SEQ ID NO: 212 - protein, 111 aa, Homo Sapien
MGLLLLVLFLSLLPVAYTIMSLPPSFDCGPFRCRVSVAREHLPSRGSLLRGPRPRIPVLVSCQPVKGHGTLGESPMPFKRVFCQDGNVRSFCVCAVHFSSHQPPVAVECLK

SEQ ID NO: 213 - DNA, 2159 bp, Homo Sapien
agggcccgcgggtggagagagcgacgcccgaggggatggcggcagcgtcccggagcgcctctggctgggcgctactgctgctggtggcactttggcagcagcgcgcggccggctccggcgtcttccagctgcagctgcaggagttcatcaacgagcgcggcgtactggccagtgggcggccttgcgagcccggctgccggactttcttccgcgtctgccttaagcacttccaggcggtcgtctcgcccggaccctgcaccttcgggaccgtctccacgccggtattgggcaccaactccttcgctgtccgggacgacagtagcggcggggggcgcaaccctctccaactgcccttcaatttcacctggccgggtaccttctcgctcatcatcgaagcttggcacgcgccaggagacgacctgcggccagaggccttgccaccagatgcactcatcagcaagatcgccatccagggctccctagctgtgggtcagaactggttattggatgagcaaaccagcaccctcacaaggctgcgctactcttaccgggtcatctgcagtgacaactactatggagacaactgctcccgcctgtgcaagaagcgcaatgaccacttcggccactatgtgtgccagccagatggcaacttgtcctgcctgcccggttggactggggaatattgccaacagcctatctgtctttcgggctgtcatgaacagaatggctactgcagcaagccagcagagtgcctctgccgcccaggctggcagggccggctgtgtaacgaatgcatcccccacaatggctgtcgccacggcacctgcagcactccctggcaatgtacttgtgatgagggctggggaggcctgttttgtgaccaagatctcaactactgcacccaccactccccatgcaagaatggggcaacgtgctccaacagtgggcagcgaagctacacctgcacctgtcgcccaggctacactggtgtggactgtgagctggagctcagcgagtgtgacagcaacccctgtcgcaatggaggcagctgtaaggaccaggaggatggctaccactgcctgtgtcctccgggctactatggcctgcactgtgaacacagcaccttgagctgcgccgactccccctgcttcaatgggggctcctgccgggagcgcaaccagggggccaactatgcttgtgaatgtccccccaacttcaccggctccaactgcgagaagaaagtggacaggtgcaccagcaacccctgtgccaacgggggacagtgcctgaaccgaggtccaagccgcatgtgccgctgccgtcctggattcacgggcacctactgtgaactccacgtcagcgactgtgcccgtaacccttgcgcccacggtggcacttgccatgacctggagaatgggctcatgtgcacctgccctgccggcttctctggccgacgctgtgaggtgcggacatccatcgatgcctgtgcctcgagtccctgcttcaacagggccacctgctacaccgacctctccacagacacctttgtgtgcaactgcccttatggctttgtgggcagccgctgcgagttccccgtgggcttgccgcccagcttcccctgggtggccgtctcgctgggtgtggggctggcagtgctgctggtactgctgggcatggtggcagtggctgtgcggcagctgcggcttcgacggccggacgacggcagcagggaagccatgaacaacttgtcggacttccagaaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatatgctcccccagggactccatgtaccagtctgtgtgtttgatatcagaggagaggaatgaatgtgtcattgccacggaggtataaggcaggagcctacctggacatccctgctcagccccgcggctggaccttccttctgcattgtttaca

SEQ ID NO: 214 - protein, 685 aa, Homo Sapien
MAAASRSASGWALLLLVALWQQRAAGSGVFQLQLQEFINERGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAICSPRDSMYQSVCLISEERNECVIATEV

SEQ ID NO: 215 - DNA, 3060 bp, Homo Sapien
cgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagaaatgacttcatctgttatatctgtaaaaaatgcctcttctgagtactctgggacatacagctgtacagtcagaaacagagtgggctctgatcagtgcctgttgcgtctaaacgttgtccctccttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaagttcaagtacccttacaagactgatggaattacagttgtataaatatggactactgaagaatctgaagtattgtattatttgactttattttaggcctctagtaaagacttaaatgttttttaaaaaaagcacaaggcacagagattagagcagctgtaagaacacatctactttatgcaatggcattagacatgtaagtcagatgtcatgtcaaaattagtacgagccaaattctttgttaaaaaaccctatgtatagtgacactgatagttaaaagatgttttattatattttcaataactaccactaacaaatttttaacttttcatatgcatattctgatatgtggtcttttaggaaaagtatggttaatagttgatttttcaaaggaaattttaaaattcttacgttctgtttaatgtttttgctatttagttaaatacattgaagggaaatacccgttcttttccccttttatgcacacaacagaaacacgcgttgtcatgcctcaaactattttttatttgcaactacatgatttcacacaattctcttaaacaacgacataaaatagatttccttgtatataaataacttacatacgctccataaagtaaattctcaaaggtgctagaacaaatcgtccacttctacagtgttctcgtatccaacagagttgatgcacaatatataaatactcaagtccaatattaaaaacttaggcacttgactaactttaataaaatttctcaaactatatcaatatctaaagtgcatatattttttaagaaagattattctcaataacttctataaaaataagtttgatggtttggcccatctaacttcactactattagtaagaacttttaacttttaatgtgtagtaaggtttattctacctttttctcaacatgacaccaacacaatcaaaaacgaagttagtgaggtgctaacatgtgaggattaatccagtgattccggtcacaatgcattccaggaggaggtacccatgtcactggaattgggcgatatggtttattttttcttccctgatttggataaccaaatggaacaggaggaggatagtgattctgatggccattccctcgatacattcctggcttttttctgggcaaagggtgccacattggaagaggtggaaatataagttctgaaatctgtagggaagagaacacattaagttaattcaaaggaaaaaatcatcatctatgttccagatttctcattaaagacaaagttacccacaacactgagatcacatctaagtgacactcctattgtcaggtctaaatacattaaaaacctcatgtgtaataggcgtataatgtataacaggtgaccaatgttttctgaatgcataaagaaatgaataaactcaaacacagtacttcctaaacaacttcaaccaaaaaagaccaaaacatggaacgaatggaagcttgtaaggacatgcttgttttagtccagtggtttccacagctggctaagccaggagtcacttggaggcttttaaatacaaaacattggagctggaggccattatccttagcaaactaatgcagaaacagaaaatcaactaccgcatgttctcacttataagtgggaggtaatgataagaacttatgaacacaaagaaggaaacaatagacattggagtctatttgagaggggagggtgggagaaggaaaaggagcagaaaagataactattgagtactgccttcacacctgggtgatgaaataatatgtacaacaaatccctgtgacacatgtttacctatggaacaaaccttcatgtgtatccctaaacctaaaataaaagttaaaaaaaaaaaaaraaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 216 - protein, 352 aa, Homo Sapien
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKFKYPYKTDGITVV

SEQ ID NO: 217 - DNA, 1571 bp, Homo Sapien
gatggcgcagccacagcttctgtgagattcgatttctccccagttcccctgtgggtctgaggggaccagaagggtgagctacgttggctttctggaaggggaggctatatgcgtcaattccccaaaacaagttttgacatttcccctgaaatgtcattctctatctattcactgcaagtgcctgctgttccaggccttacctgctgggcactaacggcggagccaggatggggacagaataaaggagccacgacctgtgccaccaactcgcactcagactctgaactcagacctgaaatcttctcttcacgggaggcttggcagtttttcttactcctgtggtctccagatttcaggcctaagatgaaagcctctagtcttgccttcagccttctctctgctgcgttttatctcctatggactccttccactggactgaagacactcaatttgggaagctgtgtgatcgccacaaaccttcaggaaatacgaaatggattttctgagatacggggcagtgtgcaagccaaagatggaaacattgacatcagaatcttaaggaggactgagtctttgcaagacacaaagcctgcgaatcgatgctgcctcctgcgccatttgctaagactctatctggacagggtatttaaaaactaccagacccctgaccattatactctccggaagatcagcagcctcgccaattcctttcttaccatcaagaaggacctccggctctctcatgcccacatgacatgccattgtggggaggaagcaatgaagaaatacagccagattctgagtcactttgaaaagctggaacctcaggcagcagttgtgaaggctttgggggaactagacattcttctgcaatggatggaggagacagaataggaggaaagtgatgctgctgctaagaatattcgaggtcaagagctccagtcttcaatacctgcagaggaggcatgaccccaaaccaccatctctttactgtactagtcttgtgctggtcacagtgtatcttatttatgcattacttgcttccttgcatgattgtctttatgcatccccaatcttaattgagaccatacttgtataagatttttgtaatatctttctgctattggatatatttattagttaatatatttatttattttttgctatttaatgtatttatttttttacttggacatgaaactttaaaaaaattcacagattatatttataacctgactagagcaggtgatgtatttttatacagtaaaaaaaaaaaaccttgtaaattctagaagagtggctaggggggttattcatttgtattcaactaaggacatatttactcatgctgatgctctgtgagatatttgaaattgaaccaatgactacttaggatgggttgtggaataagttttgatgtggaattgcacatctaccttacaattactgaccatccccagtagactccccagtcccataattgtgtatcttccagccaggaatcctacacggccagcatgtatttctacaaataaagttttctttgcataccaaaaaaaaaaaaaaaaaaa

SEQ ID NO: 218 - protein, 176 aa, Homo Sapien [sequence omitted]

SEQ ID NO: 219 - DNA, 2870 bp, Homo Sapien
cgcggagccctgcgctgggaggtgcacggtgtgcacgctggactggacccccatgcaaccccgcgccctgcgccttaaccaggactgctccgcgcgcccctgagcctcgggctccggcccggacctgcagcctcccaggtggctgggaagaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcgcaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggcgctgtcatccacccagccactcagacgtccctccaggaagcttaaagaacctgcttctttctgcagtagaagcgtgtgctggaacccaaagagtactcctttgttaggcttatggactgagcagtctggaccttgcatggcttctggggcaaaaataaatctgaaccaaactgacggcatttgaagcctttcagccagttgcttctgagccagaccagctgtaagctgaaacctcaatgaataacaagaaaagactccaggccgactcatgatactctgcatctttcctacatgagaagcttctctgccacaaaagtgacttcaaagactgatgggttgagctggcagcctatgagattgtggacatataacaagaaacagaaatgccctcatgcttattttcatggtgattgtggttttacaagactgaagacccagagtatactttttctttccagaaataatttcataccgcctatgaaatatcagataaattaccttagcttttatgtagaatgggttcaaaagtgagtgtttctatttgagaaggacactttttcatcatctaaactgattcgcataggtggttagaatggccctcatattgcctgcctaaatcttgggtttattagatgaagtttactgaatcagaggaatcagacagaggaggatagctctttccagaatccacacttctgacctcagcctcggtctcatgaacacccgctgatctcaggagaacacctgggctagggaatgtggtcgagaaagggcagcccattgcccagaattaacacatattgtagagacttgtatgcaaaggttggcatatttatatgaaaattagttgctatagaaacatttgttgcatctgtccctctgcctgagcttagaaggttatagaaaaagggtatttataaacataaatgaccttttacttgcattgtatcttatactaaaggctttagaaattacaacatatcaggttcccctactactgaagtagccttccgtgagaacacaccacatgttaggactagaagaaaatgcacaatttgtaggggtttggatgaagcagctgtaactgccctagtgtagtttgaccaggacattgtcgtgctccttccaattgtgtaagattagttagcacatcatctcctactttagccatccggtgttggatttaagaggacggtgcttctttctattaaagtgctccatcccctaccatctacacattagcattgtctctagagctaagacagaaattaaccccgttcagtcacaaagcagggaatggttcatttactcttaatctttatgccctggagaagacctacttgaacagggcatattttttagacttctgaacatcagtatgttcgagggtactatgatattttggtttggaattgccctgcccaagtcactgtcttttaacttttaaactgaatattaaaatgtatctgtctttcct

SEQ ID NO: 220 - protein, 417 aa, Homo Sapien
MALKVLLEQEKTFFTLLVLLGYLSCKVTCESGDCRQQEFRDRSGNCVPCNQCGPGMELSKECGFGYGEDAQCVTCRLHRFKEDWGFQKCKPCLDCAVVNRFQKANCSATSDAICGDCLPGFYRKTKLVGFQDMECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQEA

SEQ ID NO: 221 - DNA, 961 bp, Homo Sapien
ctagagagtatagggcagaaggatggcagatgagtgactccacatccagagctgcctccctttaatccaggatcctgtccttcctgtcctgtaggagtgcctgttgccagtgtggggtgagacaagtttgtcccacagggctgtctgagcagataagattaagggctgggtctgtgctcaattaactcctgtgggcacgggggctgggaagagcaaagtcagcggtgcctacagtcagcaccatgctgggcctgccgtggaagggaggtctgtcctgggcgctgctgctgcttctcttaggctcccagatcctgctgatctatgcctggcatttccacgagcaaagggactgtgatgaacacaatgtcatggctcgttacctccctgccacagtggagtttgctgtccacacattcaaccaacagagcaaggactactatgcctacagactggggcacatcttgaattcctggaaggagcaggtggagtccaagactgtattctcaatggagctactgctggggagaactaggtgtgggaaatttgaagacgacattgacaactgccatttccaagaaagcacagagctgaacaatactttcacctgcttcttcaccatcagcaccaggccctggatgactcagttcagcctcctgaacaagacctgcttggagggattccactgagtgaaacccactcacaggcttgtccatgtgctgctcccacattccgtggacatcagcactactctcctgaggactcttcagtggctgagcagctttggacttgtttgttatcctattttgcatgtgtttgagatctcagatcagtgttttagaaaatccacacatcttgagcctaatcatgtagtgtagatcattaaacatcagcattttaagaaaaaaaaaaaaaaaaaaaaaaaaaaaaaaaaaaaaaaaaaaaaaaaaaaaaaaaaaaaaaa

SEQ ID NO: 222 - protein, 147 aa, Homo Sapien
MLGLPWKGGLSWALLLLLLGSQILLIYAWHFHEQRDCDEHNVMARYLPATVEFAVHTFNQQSKDYYAYRLGHILNSWKEQVESKTVFSMELLLGRTRCGKFEDDIDNCHFQESTELNNTFTCFFTISTRPWMTQFSLLNKTCLEGFH

SEQ ID NO: 223 - DNA, 846 bp, Homo Sapien
aatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccccccataaagacaaaccaatcaaccacgacaaaggaagttgacctgaacatgtaaccatgccctaccctgttaccttgctagctgcaaaataaacttgttgctgacctgctgtgctcgcaaaaaa

SEQ ID NO: 224 - protein, 189 aa, Homo Sapien
MVMLLLLLSALAGLFGAAEGQAFHLGKCPNPPVQENFDVNKYLGRWYEIEKIPTTFENGRCIQANYSLMENGKIKVLNQELRADGTVNQIEGEATPVNLTEPAKLEVKFSWFMPSAPYWILATDYENYALVYSCTCIIQLFHVDFAWILARNPNLPPETVDSLKNILTSNNIDVKKMTVTDQVNCPKLS

SEQ ID NO: 225 - DNA, 1088 bp, Homo Sapien
gggtgattgaactaaaccttcgccgcaccgagtttgcagtacggccgtcacccgcaccgctgcctgcttgcggttggagaaatcaaggccctaccgggcctccgtagtcacctctctatagtgggcgtggccgaggccggggtgaccctgccggagcctccgctgccagcgacatgttcaaggtaattcagaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcaggaaacgtactcccaaactaagcccaagatgcaaagtttggttcaatgggggttagacagctatgactatctccaaaatgcacctcctggattttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagccaggaaatgtgaagaattcacctggaactaagtagaaaactccatgctctgccatcttaatcagttataggtaaacattggaaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagtttaaaaaaaaaaaaaaaaaaaaaaaaaaaaaaaaaaaaaaa

SEQ ID NO: 226 - protein, 198 aa, Homo Sapien
MFKVIQRSVGPASLSLLTFKVYAAPKKDSPPKNSVKVDELSLYSVPEGQSKYVEEARSQLEESISQLRHYCEPYTTWCQETYSQTKPKMQSLVQWGLDSYDYLQNAPPGFFPRLGVIGFAGLIGLLLARGSKIKKLVYPPGFMGLAASLYYPQQAIVFAQVSGERLYDWGLRGYIVIEDLWKENFQKPGNVKNSPGTK

SEQ ID NO: 227 - DNA, 2164 bp, Homo Sapien
caccggagggcacgcagctgacggagctgcgctgcgttcgcctcgtttgcctcgcgccctccactggagctgttcgcgcctcccggctcccaccgcagcccacccggcagaggagtcgctaccagcgcccagtgcgctctgtcagtccgcaaactccttgccgcccgccccgggctgggcaccaaataccaggctaccatggtctacaagactctcttcgctctttgcatcttaactgcaggatggagggtacagagtctgcctacatcagctcctttgtctgtttctcttccgacaaacattgtaccaccgaccaccatctggactagctctccacaaaacactgatgcagacactgcctccccatccaacggcactcacaacaactcggtgctcccagttacagcatcagccccaacatctctgcttcctaagaacatttccatagagtccagagaagaggagatcaccagcccaggttcgaattgggaaggcacaaacacagacccctcaccttctgggttctcgtcaacaagcggtggagtccacttaacaaccacgttggaggaacacagctcgggcactcctgaagcaggcgtggcagctacactgtcgcagtccgctgctgagcctcccacactcatctcccctcaagctccagcctcatcaccctcatccctatcaacctcaccacctgaggtcttttctgcctccgttactaccaaccatagctccactgtgaccagcacccaacccactggagctccaactgcaccagagtccccgacagaggagtccagctctgaccacacacccacttcacatgccacagctgagccagtgccccaggagaaaacacccccaacaactgtgtcaggcaaagtgatgtgtgagctcatagacatggagaccaccaccacctttcccagggtgatcatgcaggaagtagaacatgcattaagttcaggcagcatcgccgccattaccgtgacagtcattgccgtggtgctgctggtgtttggagttgcagcctacctaaaaatcaggcattcctcctatggaagacttttggacgaccatgactacgggtcctggggaaactacaacaaccctctgtacgatgactcctaacaatggaatatggcctgggatgaggattaactgttctttatttataagtgcttatccagtagaattaataagtacctgatgcgcattgaacgacaatcttaagccctgttttgttggtatggttgtttttgttttcctccctctcctctggctgctacaacttcccctttctggtacaagaagaaccattctttaaaggtgagtggaggctgatttgcagctgaagtgggccagccttgcaccagccaggccagaccaccatggtgaaggcttctttccccactgcaggacccactttgagaaggatcgaggaggaggatttgggttgttttgttaggggttactttcaggggaacatttcatttgtgttatttcttaaacttctatttaggaaattacattaagtattaatgaggggaaaggaaatgagctctacgaggatttcaccttgcatgggagagagcagggttttctcagattcctttttaatctctatttatctggttgtttctgacaggatgctgcctgcttggctctacgagctggaaagcagcttcttagctgcctaattaatgaaagatgaaaataggaagtgccctggagggggccagcaggtcacggggcagaatctctcaggttgctgtgggatctcagtgtgcccctacctgttctcccctccaggccacctgtctctgtaaaggatgtctgctctgttcaaaaggcagctgggatcccagcccacaagtgatcagcagagttgcatttccaaagaaaaaggctatgagatgagctgagttatagagagaaagggagaggcatgtacggtgtggggaagtggaagagaagctggcgggggagaaggaggctaacctgcactgagtacttcattaggacaagtgagaatcagctattgataatggccagagatatccacagcttggaggagcccagagactgtttgctttatacccacacagcaactggtccactgctttactgtctgttggataatggctgtaaaatgtttaaaaac

SEQ ID NO: 228 - protein, 310 aa, Homo Sapien
MVYKTLFALCILTAGWRVQSLPTSAPLSVSLPTNIVPPTTIWTSSPQNTDADTASPSNGTHNNSVLPVTASAPTSLLPKNISIESREEEITSPGSNWEGTNTDPSPSGFSSTSGGVHLTTTLEEHSSGTPEAGVAATLSQSAAEPPTLISPQAPASSPSSLSTSPPEVFSASVTTNHSSTVTSTQPTGAPTAPESPTEESSSDHTPTSHATAEPVPQEKTPPTTVSGKVMCELIDMETTTTFPRVIMQEVEHALSSGSIAAITVTVIAVVLLVFGVAAYLKIRHSSYGRLLDDHDYGSWGNYNNPLYDDS

SEQ ID NO: 229 - DNA, 633 bp, Homo Sapien
ctcctgcactaggctctcagccagggatgatgcgctgctgccgccgccgctgctgctgccggcaaccaccccatgccctgaggccgttgctgttgctgcccctcgtccttttacctcccctggcagcagctgcagcgggcccaaaccgatgtgacaccatataccagggcttcgccgagtgtctcatccgcttgggggacagcatgggccgcggaggcgagctggagaccatctgcaggtcttggaatgacttccatgcctgtgcctctcaggtcctgtcaggctgtccggaggaggcagctgcagtgtgggaatcactacagcaagaagctcgccaggccccccgtccgaataacttgcacactctgtgcggtgccccggtgcatgttcgggagcgcggcacaggctccgaaaccaaccaggagacgctgcgggctacagcgcctgcactccccatggcccctgcgcccccactgctggcggctgctctggctctggcctacctcctgaggcctctggcctagcttgttgggttgggtagcagcgcccgtacctccagccctgctctggcggtggttgtccaggctctgcagagcgcagcagggcttttcattaaaggtatttatatttgta

SEQ ID NO: 230 - protein, 165 aa, Homo Sapien
MMRCCRRRCCCRQPPHALRPLLLLPLVLLPPLAAAAAGPNRCDTIYQGFAECLIRLGDSMGRGGELETICRSWNDFHACASQVLSGCPEEAAAVWESLQQEARQAPRPNNLHTLCGAPVHVRERGTGSETNQETLRATAPALPMAPAPPLLAAALALAYLLRPLA

SEQ ID NO: 231 - DNA, 890 bp, Homo Sapien
aagtacttgtgtccgggtggtggactggattagctgcggagccctggaagctgcctgtccttctccctgtgcttaaccagaggtgcccatgggttggacaatgaggctggtcacagcagcactgttactgggtctcatgatggtggtcactggagacgaggatgagaacagcccgtgtgcccatgaggccctcttggacgaggacaccctcttttgccagggccttgaagttttctacccagagttggggaacattggctgcaaggttgttcctgattgtaacaactacagacagaagatcacctcctggatggagccgatagtcaagttcccgggggccgtggacggcgcaacctatatcctggtgatggtggatccagatgcccctagcagagcagaacccagacagagattctggagacattggctggtaacagatatcaagggcgccgacctgaagaaagggaagattcagggccaggagttatcagcctaccaggctccctccccaccggcacacagtggcttccatcgctaccagttctttgtctatcttcaggaaggaaaagtcatctctctccttcccaaggaaaacaaaactcgaggctcttggaaaatggacagatttctgaaccgcttccacctgggcgaacctgaagcaagcacccagttcatgacccagaactaccaggactcaccaaccctccaggctcccagaggaagggccagcgagcccaagcacaaaaccaggcagagatagctgcctgctagatagccggctttgccatccgggcatgtggccacactgctcaccaccgacgatgtgggtatggaaccccctctggatacagaaccccttcttttccaaattaaaaaaaaaaatcatcaaa

SEQ ID NO: 232 - protein, 223 aa, Homo Sapien [sequence omitted]

SEQ ID NO: 233 - DNA, 924 bp, Homo Sapien
aaggagcagcccgcaagcaccaagtgagaggcatgaagttacagtgtgtttccctttggctcctgggtacaatactgatattgtgctcagtagacaaccacggtctcaggagatgtctgatttccacagacatgcaccatatagaagagagtttccaagaaatcaaaagagccatccaagctaaggacaccttcccaaatgtcactatcctgtccacattggagactctgcagatcattaagcccttagatgtgtgctgcgtgaccaagaacctcctggcgttctacgtggacagggtgttcaaggatcatcaggagccaaaccccaaaatcttgagaaaaatcagcagcattgccaactctttcctctacatgcagaaaactctgcggcaatgtcaggaacagaggcagtgtcactgcaggcaggaagccaccaatgccaccagagtcatccatgacaactatgatcagctggaggtccacgctgctgccattaaatccctgggagagctcgacgtctttctagcctggattaataagaatcatgaagtaatgttctcagcttgatgacaaggaacctgtatagtgatccagggatgaacaccccctgtgcggtttactgtgggagacagcccaccttgaaggggaaggagatggggaaggccccttgcagctgaaagtcccactggctggcctcaggctgtcttattccgcttgaaaataggcaaaaagtctactgtggtatttgtaataaactctatctgctgaaagggcctgcaggccatcctgggagtaaagggctgccttcccatctaatttattgtaaagtcatatagtccatgtctgtgatgtgagccaagtgatatcctgtagtacacattgtactgagtggtttttctgaataaattccatattttacctatga

SEQ ID NO: 234 - protein, 177 aa, Homo Sapien
MKLQCVSLWLLGTILILCSVDNHGLRRCLISTDMHHIEESFQEIKRAIQAKDTFPNVTILSTLETLQIIKPLDVCCVTKNLLAFYVDRVFKDHQEPNPKILRKISSIANSFLYMQKTLRQCQEQRQCHCRQEATNATRVIHDNYDQLEVHAAAIKSLGELDVFLAWINKNHEVMFSA

SEQ ID NO: 235 - DNA, 1161 bp, Homo Sapien
  unsure 1149: unknown base
gcccgggcggctgcccttgggtgctcccttccctgcccgacacccagaccgaccttgaccgcccacctggcaggagcaggacaggacggccggacgcggccatggccgagctcccggggccctttctctgcggggccctgctaggcttcctgtgcctgagtgggctggccgtggaggtgaaggtacccacagagccgctgagcacgcccctggggaagacagccgagctgacctgcacctacagcacgtcggtgggagacagcttcgccctggagtggagctttgtgcagcctgggaaacccatctctgagtcccatccaatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctggttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcgggaggatgccatcgctcctgggatctctgagcacacttgtatgagggctgattctagcaaggggttcctggaaagaccctcgtctgccagcaccgtgacgaccaccaagtccaagctccctatggtcgtgtgacttctcccgatccctgagggcggtgagggggaatatcaataattaaagtctgtgggtacccttnaaaaaaaaaaaa

SEQ ID NO: 236 - protein, 327 aa, Homo Sapien
MAELPGPFLCGALLGFLCLSGLAVEVKVPTEPLSTPLGKTAELTCTYSTSVGDSFALEWSFVQPGKPISESHPILYFTNGHLYPTGSKSKRVSLLQNPPTVGVATLKLTDVHPSDTGTYLCQVNNPPDFYTNGLGLINLTVLVPPSNPLCSQSGQTSVGGSTALRCSSSEGAPKPVYNWVRLGTFPTPSPGSMVQDEVSGQLILTNLSLTSSGTYRCVATNQMGSASCELTLSVTEPSQGRVAGALIGVLLGVLLLSVAAFCLVRFQKERGKKPKETYGGSDLREDAIAPGISEHTCMRADSSKGFLERPSSASTVTTTKSKLPMVV

SEQ ID NO: 237 - DNA, 983 bp, Homo Sapien
ggatgcagcagagaggagcagctggaagccgtggctgcgctctcttccctctgctgggcgtcctgttcttccagggtgtttatatcgtcttttccttggagattcgtgcagatgcccatgtccgaggttatgttggagaaaagatcaagttgaaatgcactttcaagtcaacttcagatgtcactgacaagcttactatagactggacatatcgccctcccagcagcagccacacagtatcaatatttcattatcagtctttccagtacccaaccacagcaggcacatttcgggatcggatttcctgggttggaaatgtatacaaaggggatgcatctataagtataagcaaccctaccataaaggacaatgggacattcagctgtgctgtgaagaatcccccagatgtgcaccataatattcccatgacagagctaacagtcacagaaaggggttttggcaccatgctttcctctgtggcccttctttccatccttgtctttgtgccctcagccgtggtggttgctctgctgctggtgagaatggggaggaaggctgctgggctgaagaagaggagcaggtctggctataagaagtcatctattgaggtttccgatgacactgatcaggaggaggaagaggcgtgtatggcgaggctttgtgtccgttgcgctgagtgcctggattcagactatgaagagacatattgatgaaagtctgtatgacacaagaagagtcacctaaagacaggaaacatcccattccactggcagctaaagcctgtcagagaaagtggagctggcctggaccatagcgatggacaatcctggagatcatcagtaaagactttaggaaccacttatttattgaataaatgttcttgttgtatttataaactgttcaggaagtctcataagagactcatgacttcccctttcaatgaattatgctgtaattgaatgaagaaattcttttcctgagca

SEQ ID NO: 238 - protein, 235 aa, Homo Sapien
MQQRGAAGSRGCALFPLLGVLFFQGVYIVFSLEIRADAHVRGYVGEKIKLKCTFKSTSDVTDKLTIDWTYRPPSSSHTVSIFHYQSFQYPTTAGTFRDRISWVGNVYKGDASISISNPTIKDNGTFSCAVKNPPDVHHNIPMTELTVTERGFGTMLSSVALLSILVFVPSAVVVALLLVRMGRKAAGLKKRSRSGYKKSSIEVSDDTDQEEEEACMARLCVRCAECLDSDYEETY

SEQ ID NO: 239 - DNA, 2024 bp, Homo Sapien
caggcgggcccccgcgcggcagggccctggacccgcgcggctcccggggatggtgagcaaggcgctgctgcgcctcgtgtctgccgtcaaccgcaggaggatgaagctgctgctgggcatcgccttgctggcctacgtcgcctctgtttggggcaacttcgttaatatgaggtctatccaggaaaatggtgaactaaaaattgaaagcaagattgaagagatggttgaaccactaagagagaaaatcagagatttagaaaaaagctttacccagaaatacccaccagtaaagtttttatcagaaaaggatcggaaaagaattttgataacaggaggcgcagggttcgtgggctcccatctaactgacaaactcatgatggacggccacgaggtgaccgtggtggacaatttcttcacgggcaggaagagaaacgtggagcactggatcggacatgagaacttcgagttgattaaccacgacgtggtggagcccctctacatcgaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcagcgatctagtgaatggcctcgtggctctcatgaacagcaacgtcagcagcccggtcaacctggggaacccagaagaacacacaatcctagaatttgctcagttaattaaaaaccttgttggtagcggaagtgaaattcagtttctctccgaagcccaggatgacccacagaaaagaaaaccagacatcaaaaaagcaaagctgatgctggggtgggagcccgtggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttataaaagtgggtacttaataaatgagtcgttatactatgcataaagaaaaatcctagcagtattgtcaggtggtggtgcgccggcattgattttagggcagataaaagaattctgtgtgagagctttatgtttctcttttaattcagagtttttccaaggtctacttttgagttgcaaacttgactttgaaatattcctgttggtcatgatcaaggatatttgaaatcactactgtgttttgctgcgtatctggggcgggggcaggttggggggcacaaagttaacatattcttggttaaccatggttaaatatgctattttaataaaatattgaaactca

SEQ ID NO: 240 - protein, 420 aa, Homo Sapien
MVSKALLRLVSAVNRRRMKLLLGIALLAYVASVWGNFVNMRSIQENGELKIESKIEEMVEPLREKIRDLEKSFTQKYPPVKFLSEKDRKRILITGGAGFVGSHLTDKLMMDGHEVTVVDNFFTGRKRNVEHWIGHENFELINHDVVEPLYIEVDQIYHLASPASPPNYMYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLGNPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 241 - DNA, 2025 bp, Homo Sapien
gcccggtggagaattaggtgctgctgggagctcctgcctcccacaggattccagctgcagggagcctcagggactctgggccgcacggagttgggggcattccccagagagcgtcgccatggtctgcagggagcagttatcaaagaatcaggtcaagtgggtgtttgccggcattacctgtgtgtctgtggtggtcattgccgcaatagtccttgccatcaccctgcggcggccaggctgtgagctggaggcctgcagccctgatgccgacatgctggactacctgctgagcctgggccagatcagccggcgagatgccttggaggtcacctggtaccacgcagccaacagcaagaaagccatgacagctgccctgaacagcaacatcacagtcctggaggctgacgtcaatgtagaagggctcggcacagccaatgagacaggagttcccatcatggcacacccccccactatctacagtgacaacacactggagcagtggctggacgctgtgctgggctcttcccaaaagggcatcaaactggacttcaagaacatcaaggcagtgggcccctccctggacctcctgcggcagctgacagaggaaggcaaagtccggcggcccatatggatcaacgctgacatcttaaagggccccaacatgctcatctcaactgaggtcaatgccacacagttcctggccctggtccaggagaagtatcccaaggctaccctatctccaggctggaccaccttctacatgtccacgtccccaaacaggacgtacacccaagccatggtggagaagatgcacgagctggtgggaggagtgccccagagggtcaccttccctgtacggtcttccatggtgcgggctgcctggccccacttcagctggctgctgagccaatctgagaggtacagcctgacgctgtggcaggctgcctcggaccccatgtcggtggaagatctgctctacgtccgggataacactgctgtccaccaagtctactatgacatctttgagcctctcctgtcacagttcaagcagctggccttgaatgccacacggaaaccaatgtactacacgggaggcagcctgatccctcttctccagctgcctggggatgacggtctgaatgtggagtggctggttcctgacgtccagggcagcggtaaaacagcaacaatgaccctcccagacacagaaggcatgatcctgctgaacactggcctcgagggaactgtggctgaaaaccccgtgcccattgttcatactccaagtggcaacatcctgacgctggagtcctgcctgcagcagctggccacacatcccggacactggggcatccatttgcaaatagtggagcccgcagccctccggccatccctggccttgctggcacgcctctccagccttggcctcttgcattggcctgtgtgggttggggccaaaatctcccacgggagtttttcggtccccggccatgtggctggcagagagctgcttacagctgtggctgaggtcttcccccacgtgactgtggcaccaggctggcctgaggaggtgctgggcagtggctacagggaacagctgctcacagatatgctagagttgtgccaggggctctggcaacctgtgtccttccagatgcaggccatgctgctgggccacagcacagctggagccataggcaggctgctggcatcctccccccgggccaccgtcacagtggagcacaacccagctgggggcgactatgcctctgtgaggacagcattgctggcagctagggctgtggacaggacccgagtctactacaggctaccccagggctaccacaaggacttgctggctcatgttggtagaaactgagcacccaggggtggtgggccagcggacctcagggcggaggcttcccacggggaggcaggaagaaataaaggtctttggctttctccaggcaaaaaaaaaaaaaaaaaaaaaaaaaaaaaaaaaaaaaaaaaaaaaaaaaaaaaaaaaag

SEQ ID NO: 242 - protein, 585 aa, Homo Sapien [sequence omitted]

SEQ ID NO: 243 - DNA, 1152 bp, Homo Sapien
cttcagaacaggttctccttccccagtcaccagttgctcgagttagaattgtctgcaatggccgccctgcagaaatctgtgagctctttccttatggggaccctggccaccagctgcctccttctcttggccctcttggtacagggaggagcagctgcgcccatcagctcccactgcaggcttgacaagtccaacttccagcagccctatatcaccaaccgcaccttcatgctggctaaggaggctagcttggctgataacaacacagacgttcgtctcattggggagaaactgttccacggagtcagtatgagtgagcgctgctatctgatgaagcaggtgctgaacttcacccttgaagaagtgctgttccctcaatctgataggttccagccttatatgcaggaggtggtgcccttcctggccaggctcagcaacaggctaagcacatgtcatattgaaggtgatgacctgcatatccagaggaatgtgcaaaagctgaaggacacagtgaaaaagcttggagagagtggagagatcaaagcaattggagaactggatttgctgtttatgtctctgagaaatgcctgcatttgaccagagcaaagctgaaaaatgaataactaaccccctttccctgctagaaataacaattagatgccccaaagcgattttttttaaccaaaaggaagatgggaagccaaactccatcatgatgggtggattccaaatgaacccctgcgttagttacaaaggaaaccaatgccacttttgtttataagaccagaaggtagactttctaagcatagatatttattgataacatttcattgtaactggtgttctatacacagaaaacaatttattttttaaataattgtctttttccataaaaaagattactttccattcctttaggggaaaaaacccctaaatagcttcatgtttccataatcagtactttatatttataaatgtatttattattattataagactgcattttatttatatcattttattaatatggatttatttatagaaacatcattcgatattgctacttgagtgtaaggctaatattgatatttatgacaataattatagagctataacatgtttatttgacctcaataaacacttggatatccc

SEQ ID NO: 244 - protein, 179 aa, Homo Sapien
MAALQKSVSSFLMGTLATSCLLLLALLVQGGAAAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 245 - DNA, 43 bp, Artificial Sequence
  Synthetic Oligonucleotide Probe
tgtaaaacgacggccagttaaatagacctgcaattattaatct

SEQ ID NO: 246 - DNA, 41 bp, Artificial Sequence
  Synthetic Oligonucleotide Probe
caggaaacagctatgaccacctgcacacctgcaaatccatt

What is claimed is:

1. An isolated polypeptide comprising:
   (a) the amino acid sequence of the polypeptide of SEQ ID NO: 12;
   (b) the amino acid sequence of the polypeptide of SEQ ID NO: 12, lacking its associated signal peptide; or
   (c) the amino acid sequence of the polypeptide encoded by the full-length coding sequence of the cDNA deposited under ATCC accession number PTA-2315.

2. The isolated polypeptide of claim 1 comprising the amino acid sequence of the polypeptide of SEQ ID NO: 12.

3. The isolated polypeptide of claim 1 comprising the amino acid sequence of the polypeptide of SEQ ID NO: 12, lacking its associated sfgnal peptide.

4. The isolated polypeptide of claim 1 comprising the amino acid sequence of the polypeptide encoded by the full-length coding sequence of the cDNA deposited under ATCC accession number PTA-2315.

5. A chimeric polypeptide comprising a polypeptide according to claim 1 fused to a heterologous polypeptide.

6. The chimeric polypeptide of claim 5, wherein said heterologous polypeptide is an epitope tag on an Fc region of an immunoglobulin.

* * * * *

UNITED STATES PATENT AND TRADEMARK OFFICE
CERTIFICATE OF CORRECTION

PATENT NO. : 7,335,732 B2 Page 1 of 1
APPLICATION NO. : 10/216160
DATED : February 26, 2008
INVENTOR(S) : Baker et al.

It is certified that error appears in the above-identified patent and that said Letters Patent is hereby corrected as shown below:

On the title page, in the "Related U.S. Application Data": item (63) please correct the related application data as follows:

-- Continuation of Application No. 10/119,480, filed on Apr. 9, 2002, which is a continuation of Application No. PCT/US01/21066, filed on Jun. 29, 2001, now abandoned, and a continuation-in-part of Application No. PCTUS01/17800, filed on Jun. 1, 2001. --

Claim 6 Col. 116, line 23 should be:

-- The chimeric polypeptide of Claim 5, wherein said heterologous polypeptide is an epitope tag or an Fc region of an immunoglobulin. --

Signed and Sealed this

First Day of September, 2009

David J. Kappos
*Director of the United States Patent and Trademark Office*